(12) United States Patent
Musunuru et al.

(10) Patent No.: US 10,208,319 B2
(45) Date of Patent: Feb. 19, 2019

(54) THERAPEUTIC USES OF GENOME EDITING WITH CRISPR/CAS SYSTEMS

(71) Applicants: President and Fellows of Harvard College, Cambridge, MA (US); The Children's Medical Center Corporation, Boston, MA (US)

(72) Inventors: Kiran Musunuru, Cambridge, MA (US); Chad A. Cowan, Boston, MA (US); Derrick J. Rossi, Roslindale, MA (US)

(73) Assignees: President and Fellows of Harvard College, Cambridge, MA (US); The Children's Medical Center Corporation, Boston, MA (US)

( * ) Notice: Subject to any disclaimer, the term of this patent is extended or adjusted under 35 U.S.C. 154(b) by 22 days.

(21) Appl. No.: 14/509,924

(22) Filed: Oct. 8, 2014

(65) Prior Publication Data

US 2015/0152436 A1    Jun. 4, 2015

Related U.S. Application Data

(63) Continuation-in-part of application No. PCT/US2014/046034, filed on Jul. 9, 2014.

(60) Provisional application No. 61/844,333, filed on Jul. 9, 2013, provisional application No. 61/869,369, filed on Aug. 23, 2013.

(51) Int. Cl.
| | |
|---|---|
| *C12N 15/90* | (2006.01) |
| *A61K 38/46* | (2006.01) |
| *C12N 9/22* | (2006.01) |
| *A61K 48/00* | (2006.01) |

(52) U.S. Cl.
CPC .......... *C12N 15/907* (2013.01); *A61K 38/465* (2013.01); *C12N 9/22* (2013.01); *A61K 48/00* (2013.01); *C12N 2800/80* (2013.01)

(58) Field of Classification Search
CPC .............................. C12N 15/63; C12N 15/907
See application file for complete search history.

(56) References Cited

U.S. PATENT DOCUMENTS

| | | |
|---|---|---|
| 8,013,143 B2 | 9/2011 | Mcswiggen et al. |
| 8,697,359 B1 | 4/2014 | Zhang |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 9,822,370 B2 | 11/2017 | Musunuru et al. |
| 2002/0106742 A1 | 8/2002 | Samson et al. |
| 2006/0024819 A1 | 2/2006 | Finney |
| 2008/0188000 A1 | 8/2008 | Reik et al. |
| 2010/0062003 A1 | 3/2010 | Murphy et al. |
| 2010/0076057 A1 | 3/2010 | Sontheimer et al. |
| 2010/0093617 A1 | 4/2010 | Barrangou et al. |
| 2010/0227805 A1 | 9/2010 | Karin et al. |
| 2011/0262406 A1 | 10/2011 | Del Campo et al. |
| 2011/0300538 A1 | 12/2011 | Barrangou et al. |
| 2012/0088676 A1 | 4/2012 | Weill et al. |
| 2012/0142062 A1 | 6/2012 | Doyon et al. |
| 2012/0192298 A1 | 7/2012 | Weinstein et al. |
| 2012/0225927 A1 | 9/2012 | Sah et al. |
| 2012/0251618 A1 | 10/2012 | Schrum et al. |
| 2013/0122591 A1 | 5/2013 | Cost et al. |
| 2013/0156849 A1 | 6/2013 | De Fougerolles |
| 2013/0288251 A1 | 10/2013 | Horvath et al. |
| 2013/0330778 A1 | 12/2013 | Zeiner et al. |
| 2014/0080216 A1 | 3/2014 | Cost et al. |
| 2014/0093913 A1 | 4/2014 | Cost et al. |
| 2014/0134143 A1 | 5/2014 | Baylink et al. |
| 2014/0170753 A1 | 6/2014 | Zhang |
| 2014/0179006 A1 | 6/2014 | Zhang |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0227787 A1 | 8/2014 | Zhang et al. |
| 2014/0234972 A1 | 8/2014 | Zhang |
| 2014/0242664 A1 | 8/2014 | Zhang et al. |
| 2014/0242699 A1 | 8/2014 | Zhang |
| 2014/0242700 A1 | 8/2014 | Zhang et al. |
| 2014/0248702 A1 | 9/2014 | Zhang et al. |
| 2014/0256046 A1 | 9/2014 | Zhang et al. |
| 2014/0273230 A1 | 9/2014 | Chen et al. |
| 2014/0273231 A1 | 9/2014 | Zhang |
| 2014/0273232 A1 | 9/2014 | Zhang et al. |
| 2014/0273233 A1 | 9/2014 | Chen et al. |
| 2014/0273234 A1 | 9/2014 | Zhang et al. |
| 2014/0287938 A1 | 9/2014 | Zhang et al. |
| 2014/0295556 A1 | 10/2014 | Joung et al. |
| 2014/0295557 A1 | 10/2014 | Joung et al. |
| 2014/0301990 A1 | 10/2014 | Gregory et al. |
| 2014/0302563 A1 | 10/2014 | Doudna et al. |
| 2014/0310830 A1 | 10/2014 | Zhang et al. |
| 2014/0315985 A1 | 10/2014 | May et al. |

(Continued)

FOREIGN PATENT DOCUMENTS

| | | |
|---|---|---|
| WO | WO 2013/016446 | 1/2013 |
| WO | WO 2013/126794 A1 | 8/2013 |

(Continued)

OTHER PUBLICATIONS

Mali et al. (Science. Feb. 15, 2013; 339(6121): 823-826).*

(Continued)

*Primary Examiner* — Scott Long
(74) *Attorney, Agent, or Firm* — Lisa M. Warren, Esq.; Morse, Barnes-Brown & Pendleton, P.C.

(57) ABSTRACT

Disclosed herein are methods, compositions, and kits for high efficiency, site-specific genomic editing of cells for treating or preventing genetic blood disorders.

11 Claims, 186 Drawing Sheets
Specification includes a Sequence Listing.

(56) References Cited

U.S. PATENT DOCUMENTS

| | | | |
|---|---|---|---|
| 2014/0335620 | A1 | 11/2014 | Zhang et al. |
| 2014/0336133 | A1 | 11/2014 | Miller et al. |
| 2014/0342456 | A1 | 11/2014 | Mali et al. |
| 2014/0342457 | A1 | 11/2014 | Mali et al. |
| 2014/0342458 | A1 | 11/2014 | Mali et al. |
| 2014/0349405 | A1 | 11/2014 | Sontheimer et al. |
| 2014/0356956 | A1 | 12/2014 | Church et al. |
| 2014/0356958 | A1 | 12/2014 | Mali et al. |
| 2014/0356959 | A1 | 12/2014 | Church et al. |
| 2014/0357530 | A1 | 12/2014 | Zhang et al. |
| 2014/0377868 | A1 | 12/2014 | Joung et al. |
| 2015/0020223 | A1 | 1/2015 | Zhang et al. |
| 2015/0031132 | A1 | 1/2015 | Church et al. |
| 2015/0031133 | A1 | 1/2015 | Church et al. |
| 2015/0031134 | A1 | 1/2015 | Zhang et al. |
| 2015/0044191 | A1 | 2/2015 | Liu et al. |
| 2015/0044192 | A1 | 2/2015 | Liu et al. |
| 2015/0056705 | A1 | 2/2015 | Conway et al. |
| 2015/0071889 | A1 | 3/2015 | Musunuru et al. |
| 2015/0166969 | A1* | 6/2015 | Takeuchi ............ A61K 38/465 435/196 |
| 2015/0176013 | A1 | 6/2015 | Musunuru et al. |
| 2015/0344912 | A1 | 12/2015 | Kim et al. |
| 2016/0024524 | A1 | 1/2016 | Joung et al. |

FOREIGN PATENT DOCUMENTS

| | | |
|---|---|---|
| WO | WO 2014/065596 | 5/2014 |
| WO | WO 2014/093622 | 6/2014 |
| WO | WO 2014/150624 | 9/2014 |
| WO | WO 2014/151994 | 9/2014 |
| WO | WO 2014/153115 A2 | 9/2014 |
| WO | WO 2014/165825 | 10/2014 |
| WO | WO 2014/204726 A1 | 12/2014 |
| WO | WO 2015/006498 | 1/2015 |
| WO | WO 2016/057821 | 4/2016 |
| WO | WO 2016/057835 | 4/2016 |

OTHER PUBLICATIONS

Kariko et al. (Molecular Therapy. 2008; 16(11): 1833-1840).*
GenBank: AY136510.1, Kutlar, et al., "A new hemoglobin, beta chain variant 'Hb S-Wake' confirmed to be on the same chromosome with hemoglobin S mutation, detected in an African-American family," Retrieved from the internet on Dec. 23, 2015 < http://www.ncbi.nlm.nih.govInucleotide/23268448?report=genbanl<&log$=nuclalign&blast_rank=2&RID=7NNHZVRH014>.
Cho, et al., "Targeted genome engineering in human cells with the Cas9 RNA-guided endonuclease," Nature Biotechnology 31(3): 230-232 (2013).
Cong, et al., "Multiplex Genome Engineering Using CRISPR/Cas Systems," Science 339: 819-823 (2013).
Jinek, et al., "RNA-programmed genome editing in human cells," eLife Research Article pp. 1-9 (2013).
Jinek, et al., "A programmable Dual-RNA-Guided DNA Endonuclease in Adaptive Bacterial Immunity," Science 337: 816-821 (2012).
Mali, et al., "RNA-Guided Human Genome Engineering via Cas9," Science 339: 823-826 (2013).
Ran, et al., "Double Nicking by RNA-Guided CRISPR Cas9 for Enhanced Genome Editing Specificity," Cell 154: 1380-1389 (2013).
Holt, et al., "Human hematopoietic stem/progenitor cells modified by zinc-finger nucleases targeted to CCRG control HIV-1 in vivo," Nature biotechnology 28.8, 839-847 (2010).
Randau, "RNA processing in the minimal organism Nanoarchaeum equitans," Genome Biol 13.7 : 6 (2012).
Cho, et al., "Analysis of off-target effects of CRISPR/Cas-derived RNA-guided endonucleases and nickases," Genome Research (24): 132-141 (2014).
Cradick, et al., "CRISPR/Cas9 systems targeting B-globin and CCR5 genes have substantial off-target activity," Nucleic Acids Research, 1-9 (2013).
Hruscha, et al., "Efficient CRISPR/Cas9 genome editing with low off-target effects in zebrafish,"Development (140):4982-4987 (2013).
Lin, et al., "CRISPR/Cas9 systems have off-target activity with insertions or deletions between target DNA and guide RNA sequences," Nucleic Acids Research 1-13 (2014).
Talkowski, et al., "Next-Generation Sequencing Strategies Enable Routine Detection of Balanced Chromosome Rearrangements for Clinical Diagnostics and Genetic Research," The American Journal of Human Genetics (88): 469-481 (2011).
Cong,et al., "Multiplex genome engineering using CRISPR/Cas Systems," Science 21 339(6121): 819-823 (2013).
Gaj, et al., "ZFN, TALEN, and CRISPR/Cas-based methods for genome engineering," Trends in Biotechnology 31(7): 397-405 (2013).
GenBank~ M13792.1 Human adenosine deaminase (ADA) gene, complete cds [online] Oct. 4, 1995 [retrieved Oct. 25, 2014]. Available on the internet: <URL: http://www.ncbi.nlm.nih.gov/nuccore/M13792>. Especially p. 17 n\35125-35147 and nt 35090-35112.
International Search Report for International Application PCT/US2014/033082, dated Nov. 4, 2014.
International Search Report for International Application PCT/US2014/46034, dated Jan. 23, 2015.
Porteus, et al., "Gene targeting using zinc finger nucleases," Nature Biotechnology 23(8): 967-973 (2005).
Ramirez, et al., "Unexpected failure rates for modular assembly of engineered zinc fingers," Nature Methods 5(5): 374-375 (2008).
Geurts,et al., "Knockout Rats via Embryo Microinjection of Zinc-Finger Nucleases," Science 325:433 (2009).
Christian, et al., "Treating DNA Double-Strand Breaks with TAL Effector Nucleases," Genetics 757-761 (2010).
Li, et al., "In vivo genome editing restores haemostasis in a mouse model of haemophilia," Nature 475: 217-221 (2011).
High, et al., "DNA-cleaving enzymes trigger a repair process that can now be harnessed to correct mutations in the human genome in vitro. This represents another step towards gene-correction strategies for treating human disease," Nature 435 pp. 577 & 579 (2005).
Non-Final Office Action for U.S. Appl. No. 14/485,288, dated Mar. 26, 2015.
Ding, et al., "Enhanced Efficiency of Human Pluripotent Stem Cell Genome Editing through Replacing TALENs with CRISPRs," Cell Stem Cell 12: 393-394; plus supplemental materials (2013) (published online on Apr. 4, 2013).
Third Party Submission Under 37 CFR 1.290 for U.S. Appl. No. 14/485,288, made/submitted Jul. 14, 2015.
Third Party Observation for PCT Application PCT/US2014/033082, made/submitted Aug. 3, 2015.
Final Office Action for U.S. Appl. No. 14/485,288, dated Aug. 24, 2015.
GenBank: EF150856.1, Kutlar, et al., "*Homo sapiens* beta-globin (HBB) gene, HBB-Hb sickle-Monroe allele, exons 1, 2 and partial cds," Retrieved from the internet on Feb. 22, 2016.http://www.ncbi.nlm.nih.gov/nuccore/EF150856>.
Schwank, et al., "Functional Repair of CFTR by CRISPR/Cas9 in Intestinal Stem Cell Organoids of Cystic Fibrosis Patients," Cell Stem Cell 13: 653-658 (2013).
Wiginton, et al., "Complete Sequence and Structure of the Gene for Human Adenosine Deaminase," Biochemistry 25(25): 8234-8244. Abstract (1986).
Rieder, et al., *Homo sapiens* Interleukin 2 Receptor, Gamma (Severe Combined Immunodeficiency) (IL2RG) Gene, Complete cds: GENBANK: AY692262.1. Jul. 21, 2004 [Retrieved on Mar. 3, 2016]. Retrieved from the Internet: <URL: http://www.ncbi.nlm.nih.gov/nucleotide/50897 469>; pp. 1-4.
Tasher, et al., "The Genetic Basis of Severe Combined Immunodeficiency and its Variants," The Application of Clinical Genetics 5: 67-80 (2012).
Woodbine, et al., PRKDC Mutations in a SCID Patient with Profound Neurological Abnormalities. The Journal of Clinical Investigation 123(7): 2969-2980. (2013).
Kutlar, et al., A New Hemoglobin, Beta Chain Variant 'Hb S-Wake' Confirmed to be on the Same Chromosome with Hemoglobin S Mutation, Detected in an African-American Family: GENBANK: AY13651 0.1. Jul. 26, 2002 [Retrieved on Dec. 23, 2015]. Retrieved from the Internet: URL:http://www.ncbi.nlm.nih.gov/nucleotide/23268448.

(56) References Cited

OTHER PUBLICATIONS

Hendel, et al., "Quantifying Genome-Editing Outcomes at Endogenous Loci with SMRT Sequencing," Cell Reports 7: 293-305 (2014).
Lagresle-Peyrou, et al., "Human adenyiate kinase 2 deficiency causes a profound haematopoietic defect associated with sensorineural deafness," Nat Genet 41(1): 106-111 (2009).
Ding, et al., "A TALEN genome editing system to generate human stem cell-based disease models," Cell Stem Cell 12(2): 238-251 (2013).
Palu, et al.,"In pursuit of new developments for gene therapy of human diseases[1]," Journal of Biotechnology 68:1-13 (1999).
Luo, et al., "Synthetic DNA delivery systems," Nature Biotechnology 18: 33-37 (2000).
Pfeifer, et al., "Gene Therapy: Promises and Problems," Annu. Rev. Genomics Hum. Genet. 2: 177-211 (2001).
Johnson-Salbia, et al., "Gene Therapy: Optimising DNA Delivery to the Nucleus," Current Drug Targets 2: 371-399 (2001).
Shoji, et al., "Current Status of Delivery Systems to Improve Target Efficacy of Oligonucleotides," Current Pharmaceutical Design 10: 785-796 (2004).
Edelstein, et al., "Gene therapy clinical trials worldwide 1989-2004—an overview," The Journal of Gene Medicine 6: 597-302 (2004).
International Preliminary Report on Patentability for International Application PCT/US2014/46034, dated Jan. 21, 2016.
International Search Report for International Application PCT/US2015/054762, dated Mar. 11, 2016.
Non-Final Office Action for U.S. Appl. No. 14/509,787, dated Apr. 11, 2016.
Extended European Search Report from European Application 14822545.1, dated Oct. 24, 2016.
Smithies, et al., "Insertion of DNA Sequences Into the Human Chromosomal β-Globin Locus by Homologous Recombination," Nature, 317(19):230-234, (Sep. 1985).
Final Office Action for U.S. Appl. No. 14/509,787, dated Dec. 2, 2016.
Non-Final Office Action for U.S. Appl. No. 14/485,288, dated Sep. 6, 2016).
Chiba et al., "Genome Editing in Human Pluripotent Stem Cells Using Site-Specific Nucleases," Methods in Molecular Biology, 1239:267-280, (2015).
Cowan, "Human Cell-Based Models of Primary Adipocyte Disorders," National Institutes of Health Grant No. *1R01DK095384-01* (Funding Start Date Apr. 1, 2012), Abstract.
Cowan, "Integrating Lipid Genotypes and Phenotypes in IPS Derived Hepatocytes/Adipocytes," National Institutes of Health Grant No. *1U01HL107440-01* (Funding Start Date Jul. 5, 2011), Abstract.
Doudna et al., "The new frontier of genome engineering with CRISPR-Cas9," Science, 346(6213):1077, 1258096-1 through 1258096-9, (2014).
Gonzalez et al., "An iCRISPR Platform for Rapid, Multiplexable, and Inducible Genome Editing in Human Pluripotent Stem Cells," Cell Stem Cell, 15:215-226, (2014).
Hsu et al., "Development and Applications of CRISPR-Cas9 for Genome Engineering," Cell, 157:1262-1278, (2014).
Jun et al., "CRISPR/Cas: a novel way of RNA-guided genome editing," Hereditas, 35(11):1265-1273, (2013), English Abstract.
Khalili et al., "Genome editing strategies: potential tools for eradicating HIV-1/AIDS," J. Neurovirol, 21(3)310-321, (2015).
Late Breaking Abstracts: Presented at the American Society of Gene & Cell Therapy's 16th Annual Meeting, May 15-18, 2013, Salt Lake City, Utah (56 pages).
Li et al., "MAGeCK enables robust identification of essential genes from genome-scale CRISPR/Cas9 knockout screens," Genome Biology, 15:1-12, (2014).
Lin et al., "Enhanced homology-directed human genome engineering by controlled timing of CRISPR/Cas9 delivery," Elife, DOI: 10.7554:1-13, (2014).
Lloyd et al., "Beyond the antigen receptor: editing the genome of T-Cells for cancer adoptive cellular therapies," Frontiers in Immunology, 4(22):1-7, (2013).
Merkle et al., "Modeling Human Disease with Pluripotent Stem Cells: from Genome Association to Function," Cell Stem Cell, 12:656-668, (2013).
Musunuru, "Genetic and Functional Analysis of a Novel Locus Associated with LDL-C and MI," National Institutes of Health Grant No. *1K99HL098364-01*, (Funding Start Date May 3, 2010), Abstract.
Musunuru, "Stem Cell Models of Familial Combined Hypolipidemia," National Institutes of Health Grant No. *1R01HL118744-01* (Funding Start Date Feb. 1, 2013), Abstract.
Pelletier et al., "Mouse Genome Engineering via CRISPR-Cas9 for Study of Immune Function," Cell Press, 42:18-27, (2015).
Shalem et al., "Genome-Scale CRISPR-Cas9 Knockout Screening in Human Cells," Science, 343:84-87, (2014).
Wang et al., "Genetic Screens in Human Cells Using the CRISPR-Cas9 System," Science, 343:80-84, (2014).
Wang et al., "One-Step Generation of Mice Carrying Mutations in Multiple Genes by CRISPR/Cas-Mediated Genome Engineering," Cell, 153:910-918, (2013).
Wu et al., "Target specificity of the CRISPR-Cas9 system," Quantitative Biology, 2(2):59-70, 2014.
Xie et al., "Seamless gene correction of β-thalassemia mutations in patient-specific iPSCs using CRISPR/Cas9 and piggyBac," Genome Research, 24:1526-1533, (2014).
Zhang et al., "CRISPR/Cas9 for genome editing: progress, implications and challenges," HMG Advance Acess, Published Mar. 20, 2014 pp. 1-21.
International Search Report for International Application PCT/US2015/054747, dated Apr. 29, 2016.
Hwang, et al., "Efficient Genome Editing in Zebrafish Using a CRISPR-Cas System," Nature Biotechnology, 31(3):227-229, (Mar. 2013).
Jiang, et al., "RBA-Guided Editing of Bacterial Genomes Using CRISPR-Cas Systems," Nature Biotechnology, 31(3):233-239, (Mar. 2013).
Mandal, et al., "Reprogramming Human Fibroblasts to Pluripotency Using Modified mRNA," Nature Protocols, 8(3):568-582, (2013).
Ramalingam, et al., "A CRISPR Way to Engineer the Human Genome," Genome Biology, 14(107):1-4, (2013).
Shen, et al., "Generation of Gene-Modified Mice via Cas9/RNA-Mediated Gene Targeting," Cell Research, 23:720-723, (2013).
Wilen, et al., "Engineering HIV-Resistant Human CD4+ T Cells With CXCR4-Specific Zinc-Finger Nucleases," PLoS Pathogens, 7(4):1-15, (Apr. 2011).
Extended European Search Report from European Application 14779492.9, dated Dec. 20, 2016.
Cho, et al., "Targeted Genome Engineering in Human Cells with RNA-Guided Endonucleases," Supplementary Information, Nature Biotechnology, pp. 1-11, (2013).
Mandal, et al., "Efficient Ablation of Genes in Human Hematopoietic Stem and Effector Cells using CRISPR/Cas9," Cell Stem Cell, 15:643-652, (Nov. 6, 2014).
Tebas, et al., "Gene Editing of CCR5 in Autologous CD4 T Cells of Persons Infected with HIV,"The New England Journal of Medicine, 370(10):901-910, (Mar. 6, 2014).
Final Office Action for U.S. Appl. No. 14/485,288, dated Apr. 26, 2017.
Notice of Allowance for U.S. Appl. No. 14/485,288, dated Jul. 14, 2017).
Final Office Action for U.S. Appl. No. 14/509,787, dated May 24, 2018.

\* cited by examiner

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 20 | 43248474 | + | GCTTCTCTGAACCAACGAGCAGG | 1 | 2 | 17 | SEQ ID NO. 1 |
| (N20)NGG | 20 | 43248475 | + | CTTCTCTGAACCAACGAGCAGGG | 2 | 3 | 21 | SEQ ID NO. 2 |
| (N20)NGG | 20 | 43248463 | - | AGAGGTTCTGCCCTGCTCGTTGG | 1 | 2 | 19 | SEQ ID NO. 3 |
| (N20)NGG | 20 | 43248481 | - | TGGAGGAGTGGCGTCTTCAGAGG | 1 | 3 | 36 | SEQ ID NO. 4 |
| (N20)NGG | 20 | 43248951 | + | GCCTTTCCAGAACATCAATGCCG | 1 | 3 | 35 | SEQ ID NO. 5 |
| (N20)NGG | 20 | 43248986 | + | TCCTCCCAGAAGATGAAAAGAGG | 1 | 8 | 88 | SEQ ID NO. 6 |
| (N20)NGG | 20 | 43248987 | + | CCTCCCAGAAGATGAAAAGAGGG | 1 | 8 | 120 | SEQ ID NO. 7 |
| (N20)NGG | 20 | 43249018 | + | GACCTGCTCTATAAAGCCTATGG | 1 | 3 | 20 | SEQ ID NO. 8 |
| (N20)NGG | 20 | 43249019 | + | ACCTGCTCTATAAAGCCTATGGG | 1 | 5 | 24 | SEQ ID NO. 9 |
| (N20)NGG | 20 | 43249042 | + | ATGCCACCTTCAGCCTCTGCAGG | 2 | 6 | 74 | SEQ ID NO. 10 |
| (N20)NGG | 20 | 43249046 | + | CACCTTCAGCCTCTGCAGGTAGG | 1 | 5 | 86 | SEQ ID NO. 11 |
| (N20)NGG | 20 | 43249057 | + | TCTGCAGGTAGGTTCCTGTCTGG | 1 | 2 | 32 | SEQ ID NO. 12 |
| (N20)NGG | 20 | 43249058 | + | CTGCAGGTAGGTTCCTGTCTGGG | 3 | 10 | 82 | SEQ ID NO. 13 |
| (N20)NGG | 20 | 43249065 | + | TAGGTTCCTGTCTGGGCTTCTGG | 1 | 1 | 40 | SEQ ID NO. 14 |
| (N20)NGG | 20 | 43249066 | + | AGGTTCCTGTCTGGGCTTCTGGG | 1 | 5 | 66 | SEQ ID NO. 15 |
| (N20)NGG | 20 | 43248921 | - | ATGTTCTGGAAAGGCCAGAATGG | 1 | 2 | 78 | SEQ ID NO. 16 |
| (N20)NGG | 20 | 43248930 | - | GCCGCATTGATGTTCTGGAAAGG | 1 | 1 | 17 | SEQ ID NO. 17 |
| (N20)NGG | 20 | 43248935 | - | ATTTGGCCGCATTGATGTTCTGG | 1 | 1 | 9 | SEQ ID NO. 18 |
| (N20)NGG | 20 | 43248952 | - | TTCTGGGAGGAAACTAGATTTGG | 1 | 6 | 76 | SEQ ID NO. 19 |
| (N20)NGG | 20 | 43248965 | - | CCCTCTTTTCATCTTCTGGGAGG | 3 | 7 | 75 | SEQ ID NO. 20 |
| (N20)NGG | 20 | 43248968 | - | GCTCCCTCTTTTCATCTTCTGGG | 2 | 10 | 106 | SEQ ID NO. 21 |
| (N20)NGG | 20 | 43248969 | - | AGCTCCCTCTTTTCATCTTCTGG | 1 | 6 | 99 | SEQ ID NO. 22 |
| (N20)NGG | 20 | 43248998 | - | TCCCATAGGCTTTATAGAGCAGG | 1 | 2 | 13 | SEQ ID NO. 23 |
| (N20)NGG | 20 | 43249012 | - | GGCTGAAGGTGGCATCCCATAGG | 1 | 2 | 34 | SEQ ID NO. 24 |
| (N20)NGG | 20 | 43249023 | - | CTACCTGCAGAGGCTGAAGGTGG | 1 | 7 | 86 | SEQ ID NO. 25 |
| (N20)NGG | 20 | 43249026 | - | AACCTACCTGCAGAGGCTGAAGG | 1 | 4 | 42 | SEQ ID NO. 26 |
| (N20)NGG | 20 | 43249033 | - | AGACAGGAACCTACCTGCAGAGG | 2 | 9 | 79 | SEQ ID NO. 27 |
| (N20)NGG | 20 | 43249658 | + | TCTCCTCCTCCCTCTTCTGCAGG | 4 | 24 | 329 | SEQ ID NO. 28 |
| (N20)NGG | 20 | 43249674 | + | CTGCAGGCTCAAAAATGACCAGG | 1 | 5 | 39 | SEQ ID NO. 29 |
| (N20)NGG | 20 | 43249725 | + | GCTCATCTTCAAGTCCACCCTGG | 1 | 1 | 26 | SEQ ID NO. 30 |
| (N20)NGG | 20 | 43249751 | + | CTGATTACCAGATGACCAAACGG | 1 | 4 | 33 | SEQ ID NO. 31 |

FIG. 1

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 20 | 43249752 | + | TGATTACCAGATGACCAAACGGG | | 1 | 2 | 21 SEQ ID NO. 32 |
| (N20)NGG | 20 | 43249758 | + | CCAGATGACCAAACGGGACATGG | | 1 | 1 | 20 SEQ ID NO. 33 |
| (N20)NGG | 20 | 43249759 | + | CAGATGACCAAACGGGACATGGG | | 1 | 2 | 14 SEQ ID NO. 34 |
| (N20)NGG | 20 | 43249773 | + | GGACATGGGCTTTACTGAAGAGG | | 1 | 3 | 29 SEQ ID NO. 35 |
| (N20)NGG | 20 | 43249784 | + | TTACTGAAGAGGAGTTTAAAAGG | | 1 | 4 | 74 SEQ ID NO. 36 |
| (N20)NGG | 20 | 43249788 | + | TGAAGAGGAGTTTAAAAGGCTGG | | 1 | 6 | 79 SEQ ID NO. 37 |
| (N20)NGG | 20 | 43249795 | + | GAGTTTAAAAGGCTGGTGAGTGG | | 3 | 6 | 46 SEQ ID NO. 38 |
| (N20)NGG | 20 | 43249796 | + | AGTTTAAAAGGCTGGTGAGTGGG | | 1 | 6 | 48 SEQ ID NO. 39 |
| (N20)NGG | 20 | 43249811 | + | TGAGTGGGTGTGAGCCATACTGG | | 1 | 1 | 16 SEQ ID NO. 40 |
| (N20)NGG | 20 | 43249639 | - | GAGCCTGCAGAAGAGGAGGGAGG | | 4 | 21 | 222 SEQ ID NO. 41 |
| (N20)NGG | 20 | 43249642 | - | TTTGAGCCTGCAGAAGAGGAGGG | | 1 | 6 | 78 SEQ ID NO. 42 |
| (N20)NGG | 20 | 43249645 | - | ATTTTTGAGCCTGCAGAAGAGGG | | 1 | 10 | 102 SEQ ID NO. 43 |
| (N20)NGG | 20 | 43249646 | - | CATTTTTGAGCCTGCAGAAGAGG | | 1 | 8 | 72 SEQ ID NO. 44 |
| (N20)NGG | 20 | 43249670 | - | TGTTGAGCGAGTAGTTAGCCTGG | | 1 | 1 | 4 SEQ ID NO. 45 |
| (N20)NGG | 20 | 43249700 | - | GGGTGGACTTGAAGATGAGCGGG | | 1 | 4 | 28 SEQ ID NO. 46 |
| (N20)NGG | 20 | 43249701 | - | AGGGTGGACTTGAAGATGAGCCG | | 2 | 7 | 80 SEQ ID NO. 47 |
| (N20)NGG | 20 | 43249717 | - | CTGGTAATCAGTGTCCAGGGTGG | | 1 | 4 | 27 SEQ ID NO. 48 |
| (N20)NGG | 20 | 43249720 | - | CATCTGGTAATCAGTGTCCAGGG | | 1 | 2 | 30 SEQ ID NO. 49 |
| (N20)NGG | 20 | 43249721 | - | TCATCTGGTAATCAGTGTCCAGG | | 1 | 2 | 25 SEQ ID NO. 50 |
| (N20)NGG | 20 | 43249736 | - | CCATGTCCCGTTTGGTCATCTGG | | 1 | 1 | 8 SEQ ID NO. 51 |
| (N20)NGG | 20 | 43249744 | - | AGTAAACGCCCATGTCCCGTTTGG | | 1 | 1 | 6 SEQ ID NO. 52 |
| (N20)NGG | 20 | 43251239 | + | TGCTCTTCCAGATCTGCCCCTGG | | 2 | 5 | 61 SEQ ID NO. 53 |
| (N20)NGG | 20 | 43251256 | + | CCCTGGTCCAGCTACCTCACTGG | | 2 | 5 | 30 SEQ ID NO. 54 |
| (N20)NGG | 20 | 43251263 | + | CCAGCTACCTCACTGGTGCCTGG | | 1 | 5 | 42 SEQ ID NO. 55 |
| (N20)NGG | 20 | 43251270 | + | CCTCACTGGTGCCTGGAAGCCGG | | 1 | 8 | 72 SEQ ID NO. 56 |
| (N20)NGG | 20 | 43251276 | + | TGGTGCCTGGAAGCCGGACACGG | | 1 | 3 | 32 SEQ ID NO. 57 |
| (N20)NGG | 20 | 43251293 | + | ACACGGAGCATGCAGTCATTCGG | | 1 | 1 | 25 SEQ ID NO. 58 |
| (N20)NGG | 20 | 43251311 | + | TTCGGTGAGCTCTGTTCCCCTGG | | 1 | 2 | 25 SEQ ID NO. 59 |
| (N20)NGG | 20 | 43251312 | + | TCGGTGAGCTCTGTTCCCCTGGG | | 1 | 1 | 18 SEQ ID NO. 60 |
| (N20)NGG | 20 | 43251204 | - | TGGAAGACCAGGTGTGTGGCTGG | | 1 | 6 | 147 SEQ ID NO. 61 |
| (N20)NGG | 20 | 43251208 | - | GATCTGGAAGAGACAGGTGTGTGG | | 1 | 11 | 97 SEQ ID NO. 62 |

FIG. 1 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 20 | 43251215 | - | AGGGGCAGATCTGGAAGAGCAGG | | 1 | 8 | 82 SEQ ID NO. 63 |
| (N20)NGG | 20 | 43251224 | - | AGCTGGACCAGGGGCAGATCTGG | | 1 | 4 | 62 SEQ ID NO. 64 |
| (N20)NGG | 20 | 43251233 | - | CAGTGAGGTAGCTGGACCAGGGG | | 1 | 4 | 65 SEQ ID NO. 65 |
| (N20)NGG | 20 | 43251234 | - | CCAGTGAGGTAGCTGGACCAGGG | | 1 | 2 | 47 SEQ ID NO. 66 |
| (N20)NGG | 20 | 43251235 | - | ACCAGTGAGGTAGCTGGACCAGG | | 1 | 4 | 35 SEQ ID NO. 67 |
| (N20)NGG | 20 | 43251241 | - | CCAGGCACCAGTGAGGTAGCTGG | | 1 | 5 | 53 SEQ ID NO. 68 |
| (N20)NGG | 20 | 43251248 | - | CCGGCTTCCAGGCACCAGTGAGG | | 1 | 2 | 49 SEQ ID NO. 69 |
| (N20)NGG | 20 | 43251259 | - | ATGCTCCGTGTCCGGCTTCCAGG | | 1 | 1 | 10 SEQ ID NO. 70 |
| (N20)NGG | 20 | 43251267 | - | ATGACTGCATGCTCCGTGTCCGG | | 2 | 3 | 36 SEQ ID NO. 71 |
| (N20)NGG | 20 | 43251469 | + | GCTCTATTCTGCTTCTCTACAGG | | 1 | 4 | 34 SEQ ID NO. 72 |
| (N20)NGG | 20 | 43251475 | + | TTCTGCTTCTCTACAGGCTGTGG | | 1 | 11 | 100 SEQ ID NO. 73 |
| (N20)NGG | 20 | 43251495 | + | TGGACATACTCAAGACAGAGCGG | | 1 | 2 | 48 SEQ ID NO. 74 |
| (N20)NGG | 20 | 43251499 | + | CATACTCAAGACAGAGCGGCTGG | | 1 | 3 | 14 SEQ ID NO. 75 |
| (N20)NGG | 20 | 43251500 | + | ATACTCAAGACAGAGCGGCTGGG | | 1 | 1 | 16 SEQ ID NO. 76 |
| (N20)NGG | 20 | 43251506 | + | AAGACAGAGCGGCTGGGACACGG | | 1 | 9 | 81 SEQ ID NO. 77 |
| (N20)NGG | 20 | 43251520 | + | GGGACACGGCTACCACACCCTGG | | 1 | 1 | 15 SEQ ID NO. 78 |
| (N20)NGG | 20 | 43251529 | + | CTACCACACCCTGGAAGACCAGG | | 1 | 3 | 42 SEQ ID NO. 79 |
| (N20)NGG | 20 | 43251543 | + | AAGACCAGGCCCTTTATAACAGG | | 1 | 3 | 34 SEQ ID NO. 80 |
| (N20)NGG | 20 | 43251549 | + | AGGCCCTTTATAACAGGCTGCGG | | 1 | 2 | 25 SEQ ID NO. 81 |
| (N20)NGG | 20 | 43251553 | + | CCTTTATAACAGGCTGCGGCAGG | | 1 | 2 | 16 SEQ ID NO. 82 |
| (N20)NGG | 20 | 43251571 | + | GCAGGAAAACATGCACTTCGAGG | | 1 | 4 | 26 SEQ ID NO. 83 |
| (N20)NGG | 20 | 43251578 | + | AACATGCACTTCGAGGTAAGCGG | | 1 | 1 | 14 SEQ ID NO. 84 |
| (N20)NGG | 20 | 43251579 | + | ACATGCACTTCGAGGTAAGCGGG | | 1 | 1 | 10 SEQ ID NO. 85 |
| (N20)NGG | 20 | 43251584 | + | CACTTCGAGGTAAGCGGGCCAGG | | 1 | 1 | 7 SEQ ID NO. 86 |
| (N20)NGG | 20 | 43251585 | + | ACTTCGAGGTAAGCGGGCCAGGG | | 1 | 1 | 9 SEQ ID NO. 87 |
| (N20)NGG | 20 | 43251590 | + | GAGGTAAGCGGGCCAGGGAGTGG | | 2 | 6 | 85 SEQ ID NO. 88 |
| (N20)NGG | 20 | 43251591 | + | AGGTAAGCGGGCCAGGGAGTGGG | | 1 | 2 | 38 SEQ ID NO. 89 |
| (N20)NGG | 20 | 43251592 | + | GGTAAGCGGGCCAGGGAGTGGGG | | 1 | 3 | 47 SEQ ID NO. 90 |
| (N20)NGG | 20 | 43251595 | + | AAGCGGGCCAGGGAGTGGGGAGG | | 2 | 10 | 143 SEQ ID NO. 91 |
| (N20)NGG | 20 | 43251510 | - | GGGCCTGGTCTTCCAGGGTGTGG | | 1 | 5 | 82 SEQ ID NO. 92 |
| (N20)NGG | 20 | 43251515 | - | ATAAAGGGCCTGGTCTTCCAGGG | | 2 | 5 | 38 SEQ ID NO. 93 |

FIG. 1 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 20 | 43251516 | - | TATAAGGGCCTGGTCTTCCAGG | 1 | 3 | 20 | SEQ ID NO. 94 |
| (N20)NGG | 20 | 43251525 | - | GCAGCCTGTTATAAAGGGCCTGG | 1 | 4 | 23 | SEQ ID NO. 95 |
| (N20)NGG | 20 | 43251530 | - | CTGCCGCAGCCTGTTATAAAGG | 1 | 1 | 13 | SEQ ID NO. 96 |
| (N20)NGG | 20 | 43251531 | - | CCTGCCGCAGCCTGTTATAAAGG | 1 | 1 | 7 | SEQ ID NO. 97 |
| (N20)NGG | 20 | 43251647 | + | GACCTGGCTCTCCCCCTTCCAGG | 1 | 5 | 127 | SEQ ID NO. 98 |
| (N20)NGG | 20 | 43251650 | + | CTGGCTCTCCCCCTTCCAGGAGG | 1 | 4 | 116 | SEQ ID NO. 99 |
| (N20)NGG | 20 | 43251663 | + | TTCCAGGAGGCTGTGAAGAGCGG | 3 | 7 | 125 | SEQ ID NO. 100 |
| (N20)NGG | 20 | 43251687 | + | ATTCACCGTACTGTCCACGCCGG | 1 | 2 | 47 | SEQ ID NO. 101 |
| (N20)NGG | 20 | 43251688 | + | TTCACCGTACTGTCCACGCCGGG | 1 | 1 | 11 | SEQ ID NO. 102 |
| (N20)NGG | 20 | 43251689 | + | TCACCGTACTGTCCACGCCGGGG | 1 | 1 | 2 | SEQ ID NO. 103 |
| (N20)NGG | 20 | 43251692 | + | CCGTACTGTCCACGCCGGGGAGG | 1 | 1 | 3 | SEQ ID NO. 104 |
| (N20)NGG | 20 | 43251695 | + | TACTGTCCACGCCGGGGAGGTGG | 1 | 1 | 4 | SEQ ID NO. 105 |
| (N20)NGG | 20 | 43251696 | + | ACTGTCCACGCCGGGGAGGTGGG | 1 | 1 | 11 | SEQ ID NO. 106 |
| (N20)NGG | 20 | 43251701 | + | CCACGCCGGGGAGGTGGGCTCGG | 1 | 6 | 45 | SEQ ID NO. 107 |
| (N20)NGG | 20 | 43251719 | + | CTCGGCCGAAGTAGTAAAAGAGG | 1 | 2 | 6 | SEQ ID NO. 108 |
| (N20)NGG | 20 | 43251724 | + | CCGAAGTAGTAAAAGAGGTGAGG | 1 | 1 | 13 | SEQ ID NO. 109 |
| (N20)NGG | 20 | 43251725 | + | CGAAGTAGTAAAAGAGGTGAGGG | 1 | 2 | 51 | SEQ ID NO. 110 |
| (N20)NGG | 20 | 43251730 | + | TAGTAAAAGAGGTGAGGGCCTGG | 1 | 3 | 44 | SEQ ID NO. 111 |
| (N20)NGG | 20 | 43251731 | + | AGTAAAAGAGGTGAGGGCCTGGG | 1 | 2 | 55 | SEQ ID NO. 112 |
| (N20)NGG | 20 | 43251735 | + | AAAGAGGTGAGGGCCTGGGCTGG | 2 | 15 | 136 | SEQ ID NO. 113 |
| (N20)NGG | 20 | 43251741 | + | GTGAGGGCCTGGGCTGGCCATGG | 3 | 11 | 158 | SEQ ID NO. 114 |
| (N20)NGG | 20 | 43251742 | + | TGAGGGCCTGGGCTGGCCATGGG | 2 | 10 | 99 | SEQ ID NO. 115 |
| (N20)NGG | 20 | 43251743 | + | GAGGGCCTGGGCTGGCCATGGGG | 1 | 17 | 142 | SEQ ID NO. 116 |
| (N20)NGG | 20 | 43251627 | - | CTCCTGGAAGGGGAGAGCCAGG | 2 | 7 | 106 | SEQ ID NO. 117 |
| (N20)NGG | 20 | 43251636 | - | CTTCACAGCCTCCTGGAAGGGGG | 1 | 7 | 115 | SEQ ID NO. 118 |
| (N20)NGG | 20 | 43251637 | - | TCTTCACAGCCTCCTGGAAGGGG | 1 | 7 | 86 | SEQ ID NO. 119 |
| (N20)NGG | 20 | 43251638 | - | CTCTTCACAGCCTCCTGGAAGGG | 1 | 9 | 79 | SEQ ID NO. 120 |
| (N20)NGG | 20 | 43251639 | - | GCTCTTCACAGCCTCCTGGAAGG | 1 | 5 | 96 | SEQ ID NO. 121 |
| (N20)NGG | 20 | 43251643 | - | TGCCGCTCTTCACAGCCTCCTGG | 1 | 3 | 39 | SEQ ID NO. 122 |
| (N20)NGG | 20 | 43251670 | - | CCTCCCCGGCGTGGACAGTACGG | 1 | 1 | 6 | SEQ ID NO. 123 |
| (N20)NGG | 20 | 43251679 | - | CCGAGCCCACCTCCCCGGCGTGG | 1 | 5 | 37 | SEQ ID NO. 124 |

FIG. 1 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 20 | 43251684 | - | TTCGGCGAGCCGACCCCACTCCCGG | | 1 | 3 | 19 SEQ ID NO. 125 |
| (N20)NGG | 20 | 43251702 | - | CCTCACCTCTTTTACTACTTCGG | | 1 | 4 | 46 SEQ ID NO. 126 |
| (N20)NGG | 20 | 43252846 | + | TGGGCATCTCGCCCACAGACTGG | | 1 | 2 | 13 SEQ ID NO. 127 |
| (N20)NGG | 20 | 43252856 | + | GCCCACAGACTGGTCCCCAAGG | | 1 | 6 | 43 SEQ ID NO. 128 |
| (N20)NGG | 20 | 43252859 | + | CACAGACTGGTCCCCAAGGTGG | | 1 | 1 | 37 SEQ ID NO. 129 |
| (N20)NGG | 20 | 43252862 | + | AGACTGGTCCCCAAGGTGGTGG | | 1 | 2 | 36 SEQ ID NO. 130 |
| (N20)NGG | 20 | 43252895 | + | GAAGTACCAGCAGCAGACCGTGG | | 1 | 1 | 34 SEQ ID NO. 131 |
| (N20)NGG | 20 | 43252910 | + | GACCGTGGTAGCCATTGACCTGG | | 1 | 1 | 10 SEQ ID NO. 132 |
| (N20)NGG | 20 | 43252914 | + | GTGGTAGCCATTGACCTGCTGG | | 1 | 2 | 21 SEQ ID NO. 133 |
| (N20)NGG | 20 | 43252932 | + | GCTGGAGATGAGACCATCCCAGG | | 1 | 4 | 44 SEQ ID NO. 134 |
| (N20)NGG | 20 | 43252950 | + | CCAGGAAGCAGCCTCTTGCCTGG | | 2 | 11 | 127 SEQ ID NO. 135 |
| (N20)NGG | 20 | 43252961 | + | CCTCTTGCCTGGACATGTCCAGG | | 1 | 4 | 42 SEQ ID NO. 136 |
| (N20)NGG | 20 | 43252970 | + | TGGACATGTCCAGGCCTACCAGG | | 1 | 3 | 18 SEQ ID NO. 137 |
| (N20)NGG | 20 | 43252973 | + | ACATGTCCAGGCCTACCAGGTGG | | 1 | 6 | 45 SEQ ID NO. 138 |
| (N20)NGG | 20 | 43252974 | + | CATGTCCAGGCCTACCAGGTGGG | | 1 | 4 | 24 SEQ ID NO. 139 |
| (N20)NGG | 20 | 43252987 | + | ACCAGGTGGGTCCTGTGAGAAGG | | 1 | 6 | 35 SEQ ID NO. 140 |
| (N20)NGG | 20 | 43252992 | + | GTGGGTCCTGTGAGAAGGAATGG | | 1 | 14 | 148 SEQ ID NO. 141 |
| (N20)NGG | 20 | 43252818 | - | TGTGGGCGAGATGCCCACCCAGG | | 1 | 3 | 19 SEQ ID NO. 142 |
| (N20)NGG | 20 | 43252835 | - | ACCTTGGGGACCAGTCTGTGGG | | 1 | 2 | 23 SEQ ID NO. 143 |
| (N20)NGG | 20 | 43252835 | - | CACCTTGGGGACCAGTCTGTGG | | 1 | 3 | 29 SEQ ID NO. 144 |
| (N20)NGG | 20 | 43252848 | - | ACACAGCTCCACCACCTTGGGG | | 1 | 5 | 37 SEQ ID NO. 145 |
| (N20)NGG | 20 | 43252849 | - | TACACAGCTCCACCACCTTGGG | | 1 | 2 | 24 SEQ ID NO. 146 |
| (N20)NGG | 20 | 43252850 | - | TTACACAGCTCCACCACCTTGG | | 1 | 1 | 34 SEQ ID NO. 147 |
| (N20)NGG | 20 | 43252851 | - | CTTACACAGCTCCACCACCTTG | | 1 | 3 | 29 SEQ ID NO. 148 |
| (N20)NGG | 20 | 43252879 | - | TGGCTACCACCGTCTGCTCTGG | | 1 | 3 | 22 SEQ ID NO. 149 |
| (N20)NGG | 20 | 43252890 | - | AGCCAGGTCAATGGCTACCACGG | | 1 | 2 | 24 SEQ ID NO. 150 |
| (N20)NGG | 20 | 43252899 | - | CTCATCTCCAGCCAGGTCAATGG | | 1 | 7 | 131 SEQ ID NO. 151 |
| (N20)NGG | 20 | 43252906 | - | GGATGGTCTCATCTCCAGCCAGG | | 1 | 2 | 44 SEQ ID NO. 152 |
| (N20)NGG | 20 | 43252923 | - | CAAGAGGCTGCTTCCTGGGATGG | | 3 | 8 | 86 SEQ ID NO. 153 |
| (N20)NGG | 20 | 43252927 | - | CAGGCAAGAGGCTGCTTCCTGGG | | 2 | 7 | 85 SEQ ID NO. 154 |
| (N20)NGG | 20 | 43252928 | - | CCAGGCAAGAGGCTGCTTCCTGG | | 1 | 7 | 113 SEQ ID NO. 155 |

FIG. 1 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 20 | 43252939 | - | CCTGGACATGTCCAGGCAAGAGG | 1 | 2 | 50 | SEQ ID NO. 156 |
| (N20)NGG | 20 | 43252946 | - | TGGTAGGCCTGGACATGTCCAGG | 1 | 2 | 17 | SEQ ID NO. 157 |
| (N20)NGG | 20 | 43252957 | - | CAGGACCCACCTGGTAGGCCTGG | 1 | 3 | 33 | SEQ ID NO. 158 |
| (N20)NGG | 20 | 43252962 | - | TCTCACAGGACCCACCTGGTAGG | 1 | 2 | 28 | SEQ ID NO. 159 |
| (N20)NGG | 20 | 43252966 | - | TCCTTCTCACAGGACCCACCTGG | 1 | 6 | 55 | SEQ ID NO. 160 |
| (N20)NGG | 20 | 43254211 | + | CTACTCCTCTCCTCACACAGAGG | 1 | 5 | 119 | SEQ ID NO. 161 |
| (N20)NGG | 20 | 43254212 | + | TACTCCTCTCCTCACACAGAGGG | 1 | 10 | 105 | SEQ ID NO. 162 |
| (N20)NGG | 20 | 43254213 | + | ACTCCTCTCCTCACACAGAGGGG | 1 | 6 | 66 | SEQ ID NO. 163 |
| (N20)NGG | 20 | 43254231 | + | AGGGGACCTCACCCAGACGAGGG | 1 | 1 | 26 | SEQ ID NO. 164 |
| (N20)NGG | 20 | 43254234 | + | GGACCTCACCCAGACGAGGTGG | 1 | 1 | 21 | SEQ ID NO. 165 |
| (N20)NGG | 20 | 43254237 | + | CCTCACCCAGACGAGGTGGTGG | 1 | 2 | 40 | SEQ ID NO. 166 |
| (N20)NGG | 20 | 43254246 | + | AGACGAGGTGGTGGCCCTAGTGG | 1 | 2 | 24 | SEQ ID NO. 167 |
| (N20)NGG | 20 | 43254247 | + | GACGAGGTGGTGGCCCTAGTGTGG | 1 | 2 | 13 | SEQ ID NO. 168 |
| (N20)NGG | 20 | 43254252 | + | GGTGGTGGCCCTAGTGGGCCAGG | 1 | 2 | 48 | SEQ ID NO. 169 |
| (N20)NGG | 20 | 43254253 | + | GTGGTGGCCCTAGTGGGCCAGGG | 1 | 3 | 40 | SEQ ID NO. 170 |
| (N20)NGG | 20 | 43254261 | + | CCTAGTGGGCCAGGGCCTGCAGG | 1 | 4 | 43 | SEQ ID NO. 171 |
| (N20)NGG | 20 | 43254264 | + | AGTGGGCCAGGGCCTGCAGGAGG | 3 | 14 | 163 | SEQ ID NO. 172 |
| (N20)NGG | 20 | 43254265 | + | GTGGGCCAGGGCCTGCAGGAGGG | 1 | 14 | 225 | SEQ ID NO. 173 |
| (N20)NGG | 20 | 43254266 | + | TGGGCCAGGGCCTGCAGGAGGGG | 2 | 18 | 238 | SEQ ID NO. 174 |
| (N20)NGG | 20 | 43254267 | + | GGGCCAGGGCCTGCAGGAGGGGG | 2 | 32 | 318 | SEQ ID NO. 175 |
| (N20)NGG | 20 | 43254280 | + | CAGGAGGGGAGCGAGACTTCGG | 1 | 2 | 39 | SEQ ID NO. 176 |
| (N20)NGG | 20 | 43254281 | + | AGGAGGGGAGCGAGACTTCGGG | 1 | 2 | 35 | SEQ ID NO. 177 |
| (N20)NGG | 20 | 43254282 | + | GGAGGGGGAGCGAGACTTCGGGG | 1 | 1 | 29 | SEQ ID NO. 178 |
| (N20)NGG | 20 | 43254288 | + | GGAGCGAGACTTCGGGGTCAAGG | 1 | 2 | 20 | SEQ ID NO. 179 |
| (N20)NGG | 20 | 43254293 | + | GAGACTTCGGGGTCAAGGCCCGG | 1 | 2 | 18 | SEQ ID NO. 180 |
| (N20)NGG | 20 | 43254333 | - | GCGCCACCAGCCCAGTGAGTAGG | 1 | 1 | 15 | SEQ ID NO. 181 |
| (N20)NGG | 20 | 43254187 | - | TCTGTGTGAGGAGGAGGAGTAGG | 2 | 10 | 104 | SEQ ID NO. 182 |
| (N20)NGG | 20 | 43254188 | - | CCTGTGTGAGGAGGAGGAGTAGG | 2 | 11 | 148 | SEQ ID NO. 183 |
| (N20)NGG | 20 | 43254194 | - | GGTCCCCTCTGTGTGAGGAGAGG | 1 | 4 | 52 | SEQ ID NO. 184 |
| (N20)NGG | 20 | 43254199 | - | GGTGAGGTCCCCTCTGTGTGAGG | 1 | 3 | 51 | SEQ ID NO. 185 |
| (N20)NGG | 20 | 43254215 | - | CCACCACCTCGTCTGGGGTGAGG | 1 | 4 | 100 | SEQ ID NO. 186 |

FIG. 1 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 20 | 43254220 | - | TAGGGCCACCACCTCGTCTGGGG | 1 | 1 | 11 | SEQ ID NO. 187 |
| (N20)NGG | 20 | 43254221 | - | CTAGGGCCACCACCTCGTCTGGG | 1 | 2 | 16 | SEQ ID NO. 188 |
| (N20)NGG | 20 | 43254222 | - | ACTAGGGCCACCACCTCGTCTGG | 1 | 1 | 17 | SEQ ID NO. 189 |
| (N20)NGG | 20 | 43254238 | - | CTGCAGGGCCCTGGCCCACTAGGG | 1 | 7 | 54 | SEQ ID NO. 190 |
| (N20)NGG | 20 | 43254239 | - | CCTGCAGGGCCCTGGCCCACTAGG | 3 | 5 | 89 | SEQ ID NO. 191 |
| (N20)NGG | 20 | 43254248 | - | GCTCCCCTCCTGCAGGCCCTGG | 1 | 17 | 186 | SEQ ID NO. 192 |
| (N20)NGG | 20 | 43254254 | - | AGTCTCGCTCCCCTCCTGCAGG | 1 | 4 | 38 | SEQ ID NO. 193 |
| (N20)NGG | 20 | 43254289 | - | CATGCAGCACAGGATGGACCGGG | 1 | 3 | 34 | SEQ ID NO. 194 |
| (N20)NGG | 20 | 43254290 | - | GCATGCAGCACAGGATGGACCGG | 1 | 3 | 42 | SEQ ID NO. 195 |
| (N20)NGG | 20 | 43254295 | - | GTGCGCATGCAGCACAGGATGG | 1 | 3 | 62 | SEQ ID NO. 196 |
| (N20)NGG | 20 | 43254299 | - | GCTGGTGGCGCATGCAGCACAGG | 1 | 1 | 22 | SEQ ID NO. 197 |
| (N20)NGG | 20 | 43254314 | - | GATCCTACTCACTGGGCTGGTGG | 1 | 2 | 32 | SEQ ID NO. 198 |
| (N20)NGG | 20 | 43254317 | - | GGTGATCCTACTCACTGGGCTGG | 1 | 2 | 13 | SEQ ID NO. 199 |
| (N20)NGG | 20 | 43254321 | - | GGGCGGTGATCCTACTCACTGGG | 1 | 1 | 10 | SEQ ID NO. 200 |
| (N20)NGG | 20 | 43254322 | - | AGGGCGGTGATCCTACTCACTGG | 1 | 1 | 14 | SEQ ID NO. 201 |
| (N20)NGG | 20 | 43255096 | + | AACCCTTTCTTCCCTTCCCAGG | 1 | 11 | 148 | SEQ ID NO. 202 |
| (N20)NGG | 20 | 43255097 | + | ACCCCTTTCTTCCCTTCCCAGGG | 5 | 16 | 156 | SEQ ID NO. 203 |
| (N20)NGG | 20 | 43255098 | + | CCCCTTTCTTCCCTTCCCAGGGG | 1 | 18 | 215 | SEQ ID NO. 204 |
| (N20)NGG | 20 | 43255105 | + | CTTCCCTTCCCAGGGGCTGCCGG | 1 | 15 | 150 | SEQ ID NO. 205 |
| (N20)NGG | 20 | 43255106 | + | TTCCCTTCCCAGGGGCTGCCGGG | 2 | 11 | 144 | SEQ ID NO. 206 |
| (N20)NGG | 20 | 43255109 | + | CCTTCCCAGGGGCTGCCGGGAGG | 2 | 15 | 134 | SEQ ID NO. 207 |
| (N20)NGG | 20 | 43255120 | + | GCTGCCGGGAGGCTATCAAAAGG | 1 | 2 | 9 | SEQ ID NO. 208 |
| (N20)NGG | 20 | 43255148 | + | CTATGAGTTTGTAGAGATGAAGG | 1 | 2 | 59 | SEQ ID NO. 209 |
| (N20)NGG | 20 | 43255157 | + | TGTAGAGATGAAGGCCAAAGAGG | 1 | 7 | 68 | SEQ ID NO. 210 |
| (N20)NGG | 20 | 43255158 | + | GTAGAGATGAAGGCCAAAGAGGG | 1 | 10 | 86 | SEQ ID NO. 211 |
| (N20)NGG | 20 | 43255163 | + | GATGAAGGCCAAAGAGGGCGTGG | 1 | 1 | 33 | SEQ ID NO. 212 |
| (N20)NGG | 20 | 43255172 | + | CAAAGAGGGCGTGGTGTATGTGG | 1 | 3 | 17 | SEQ ID NO. 213 |
| (N20)NGG | 20 | 43255175 | + | AGAGGGCGTGGTGTATGTGGAGG | 1 | 3 | 39 | SEQ ID NO. 214 |
| (N20)NGG | 20 | 43255180 | + | GCGTGGTGTATGTGGAGGTGCGG | 1 | 3 | 88 | SEQ ID NO. 215 |
| (N20)NGG | 20 | 43255199 | + | GCGGTACAGTCCGCACCTGCTGG | 1 | 1 | 2 | SEQ ID NO. 216 |
| (N20)NGG | 20 | 43255214 | + | CCTGCTGGCCAACTCCAAAGTGG | 1 | 3 | 32 | SEQ ID NO. 217 |

FIG. 1 cont.

| site type | site chromosome | site start nucleotide | site strand | target site sequence with NGG | genome wide hits with 1 or less mismatches | genome wide hits with 2 or less mismatches | genome wide hits with 3 or less mismatches | |
|---|---|---|---|---|---|---|---|---|
| (N20)NGG | 20 | 43255228 | + | CCAAAGTGGAGCCAATCCCTGG | | 2 | 5 | 22 SEQ ID NO. 218 |
| (N20)NGG | 20 | 43255235 | + | GGAGCCAATCCCTGGAACCAGG | | 1 | 1 | 30 SEQ ID NO. 219 |
| (N20)NGG | 20 | 43255250 | + | GAACCAGGCTGAGTGAGTGATGG | | 1 | 4 | 65 SEQ ID NO. 220 |
| (N20)NGG | 20 | 43255251 | + | AACCAGGCTGAGTGAGTGATGGG | | 1 | 3 | 48 SEQ ID NO. 221 |
| (N20)NGG | 20 | 43255256 | + | GGCTGAGTGAGTGATGGGCCTGG | | 1 | 2 | 70 SEQ ID NO. 222 |
| (N20)NGG | 20 | 43255260 | + | GAGTGAGTGATGGGCCTGGAAGG | | 1 | 7 | 91 SEQ ID NO. 223 |
| (N20)NGG | 20 | 43255261 | + | AGTGAGTGATGGGCCTGGAAGGG | | 2 | 8 | 97 SEQ ID NO. 224 |
| (N20)NGG | 20 | 43255262 | + | GTGAGTGATGGGCCTGGAAGGGG | | 1 | 9 | 107 SEQ ID NO. 225 |
| (N20)NGG | 20 | 43255071 | - | GGGAAGGGAAGAAAGGGGTTGG | | 2 | 22 | 449 SEQ ID NO. 226 |
| (N20)NGG | 20 | 43255072 | - | TGGGAAGGGAAGAAAGGGGTTGG | | 3 | 32 | 451 SEQ ID NO. 227 |
| (N20)NGG | 20 | 43255076 | - | CCCCTGGGAAGGGAAGAAAGGGG | | 2 | 23 | 175 SEQ ID NO. 228 |
| (N20)NGG | 20 | 43255077 | - | GCCCCTGGGAAGGGAAGAAAAGG | | 2 | 13 | 169 SEQ ID NO. 229 |
| (N20)NGG | 20 | 43255078 | - | AGCCCCTGGGAAGGGAAGAAAGG | | 1 | 22 | 197 SEQ ID NO. 230 |
| (N20)NGG | 20 | 43255086 | - | CTCCCGGCAGCCCCTGGGAAGGG | | 2 | 7 | 127 SEQ ID NO. 231 |
| (N20)NGG | 20 | 43255087 | - | CCTCCCGGCAGCCCCTGGGAAGG | | 2 | 11 | 137 SEQ ID NO. 232 |
| (N20)NGG | 20 | 43255091 | - | ATAGCCTCCCGGCAGCCCCTGGG | | 1 | 2 | 20 SEQ ID NO. 233 |
| (N20)NGG | 20 | 43255092 | - | GATAGCCTCCCGGCAGCCCCTGG | | 1 | 1 | 15 SEQ ID NO. 234 |
| (N20)NGG | 20 | 43255102 | - | CGATCCTTTTGATAGCCTCCGG | | 1 | 1 | 11 SEQ ID NO. 235 |
| (N20)NGG | 20 | 43255125 | - | CTTCATCTCTACAAACTCATAGG | | 3 | 5 | 67 SEQ ID NO. 236 |
| (N20)NGG | 20 | 43255149 | - | CACATACACCACGCCCTCTTTGG | | 1 | 1 | 15 SEQ ID NO. 237 |
| (N20)NGG | 20 | 43255187 | - | TTGGAGTTGGCCAGCAGGTGCGG | | 1 | 5 | 56 SEQ ID NO. 238 |
| (N20)NGG | 20 | 43255192 | - | CCACTTTGGAGTTGGCCAGAGG | | 1 | 3 | 26 SEQ ID NO. 239 |
| (N20)NGG | 20 | 43255200 | - | GATTGGCTCCACTTTGGAGTTGG | | 1 | 5 | 22 SEQ ID NO. 240 |
| (N20)NGG | 20 | 43255206 | - | CCAGGGATTGGCTCCACTTTGG | | 1 | 2 | 18 SEQ ID NO. 241 |
| (N20)NGG | 20 | 43255217 | - | TCAGCCTGGTTCCAGGGGATTGG | | 1 | 4 | 79 SEQ ID NO. 242 |
| (N20)NGG | 20 | 43255222 | - | CTCACTCAGCCTGGTTCCAGGGG | | 1 | 5 | 69 SEQ ID NO. 243 |
| (N20)NGG | 20 | 43255223 | - | ACTCACTCAGCCTGGTTCCAGGG | | 1 | 7 | 79 SEQ ID NO. 244 |
| (N20)NGG | 20 | 43255224 | - | CACTCACTCAGCCTGGTTCCAGG | | 1 | 3 | 62 SEQ ID NO. 245 |
| (N20)NGG | 20 | 43255231 | - | GGCCATCACTCACTCAGCCTGG | | 1 | 2 | 39 SEQ ID NO. 246 |
| (N20)NGG | 20 | 43257687 | + | CCACTCACTGTTTTGTTTCCAGG | | 1 | 5 | 76 SEQ ID NO. 247 |
| (N20)NGG | 20 | 43257690 | + | CTCACTGTTTTGTTTCCAGGAGG | | 1 | 6 | 88 SEQ ID NO. 248 |

FIG. 1 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 20 | 43257695 | + | TGTTTGTTTCCAGGAGGAGAGG | 1 | 1 | 7 | 117 SEQ ID NO. 249 |
| (N20)NGG | 20 | 43257696 | + | GTTTTGTTTCCAGGACGAGAGGG | 1 | 1 | 11 | 95 SEQ ID NO. 250 |
| (N20)NGG | 20 | 43257724 | + | CCTCCCAGCTAACACAGCAGAGG | 1 | 1 | 5 | 52 SEQ ID NO. 251 |
| (N20)NGG | 20 | 43257725 | + | CTCCCAGCTAACACAGCAGAGGG | 1 | 1 | 5 | 66 SEQ ID NO. 252 |
| (N20)NGG | 20 | 43257726 | + | TCCCAGCTAACACAGCAGAGGGG | 1 | 1 | 7 | 53 SEQ ID NO. 253 |
| (N20)NGG | 20 | 43257743 | + | GAGGGCTGCTGAACGTCATTGG | 1 | 1 | 1 | 28 SEQ ID NO. 254 |
| (N20)NGG | 20 | 43257748 | + | GCTGCTGAACGTCATTGGCATG | 1 | 1 | 2 | 26 SEQ ID NO. 255 |
| (N20)NGG | 20 | 43257778 | + | GCTCACCCTTCCAGACTTCCTGG | 1 | 1 | 5 | 47 SEQ ID NO. 256 |
| (N20)NGG | 20 | 43257832 | + | GTGAGTTGCCCCCAACCCACAGG | 1 | 2 | 2 | 28 SEQ ID NO. 257 |
| (N20)NGG | 20 | 43257662 | - | GGAAACAAAACAGTGAGTGGTGG | 1 | 2 | 9 | 97 SEQ ID NO. 258 |
| (N20)NGG | 20 | 43257665 | - | CCTGAAACAAAACAGTGAGTGG | 1 | 2 | 5 | 106 SEQ ID NO. 259 |
| (N20)NGG | 20 | 43257683 | - | GAGGCGATCCCCTCTCCTCCTGG | 1 | 1 | 4 | 21 SEQ ID NO. 260 |
| (N20)NGG | 20 | 43257701 | - | CCTCTGCTGTGTTAGCTGGGAGG | 1 | 1 | 7 | 73 SEQ ID NO. 261 |
| (N20)NGG | 20 | 43257702 | - | CCTCTGCTGTGTTAGCTGGGAGG | 1 | 1 | 4 | 56 SEQ ID NO. 262 |
| (N20)NGG | 20 | 43257705 | - | GCCCCTCTGCTGTGTTAGCTGG | 1 | 1 | 3 | 34 SEQ ID NO. 263 |
| (N20)NGG | 20 | 43257706 | - | AGCCCCTCTGCTGTGTTAGCTGG | 1 | 1 | 4 | 32 SEQ ID NO. 264 |
| (N20)NGG | 20 | 43257754 | - | AGGAAGTCTGGAAGGGTGAGCGG | 1 | 1 | 8 | 158 SEQ ID NO. 265 |
| (N20)NGG | 20 | 43257761 | - | CTTGGCCAGGAAGTCTGGAAGG | 1 | 1 | 2 | 37 SEQ ID NO. 266 |
| (N20)NGG | 20 | 43257762 | - | ACTTGGCCAGGAAGTCTGGAAGG | 1 | 1 | 4 | 48 SEQ ID NO. 267 |
| (N20)NGG | 20 | 43257766 | - | TCAAACTTGGCCAGGAAGTCTGG | 1 | 1 | 4 | 39 SEQ ID NO. 268 |
| (N20)NGG | 20 | 43257774 | - | TGTAGTAGTCAAACTTGGCCAGG | 1 | 1 | 1 | 16 SEQ ID NO. 269 |
| (N20)NGG | 20 | 43257779 | - | AGGCATGTAGTAGTCAAACTTGG | 1 | 1 | 3 | 33 SEQ ID NO. 270 |
| (N20)NGG | 20 | 43257799 | + | GGGGCAACTCACGGATAGCAGG | 1 | 1 | 1 | 2 SEQ ID NO. 271 |
| (N20)NGG | 20 | 43264867 | + | TCTTCCCCTGCCCCCTTGCAGGTGG | 1 | 1 | 11 | 106 SEQ ID NO. 272 |
| (N20)NGG | 20 | 43264870 | + | TCCCCTGCCCCCTTGCAGGTGG | 1 | 1 | 5 | 90 SEQ ID NO. 273 |
| (N20)NGG | 20 | 43264892 | + | GAACTGCATGTCCACCTAGACG | 1 | 1 | 1 | 25 SEQ ID NO. 274 |
| (N20)NGG | 20 | 43264925 | + | CCTGAAACCATCTTATACTATGG | 1 | 1 | 5 | 49 SEQ ID NO. 275 |
| (N20)NGG | 20 | 43264929 | + | AAACCATCTTATACTATGGCAGG | 1 | 1 | 2 | 23 SEQ ID NO. 276 |
| (N20)NGG | 20 | 43264849 | - | TCCACCTGCAAGGGGCAGGGGG | 1 | 1 | 12 | 174 SEQ ID NO. 277 |
| (N20)NGG | 20 | 43264850 | - | TTCCACCTGCAAGGGGCAGGGG | 1 | 1 | 5 | 64 SEQ ID NO. 278 |
| (N20)NGG | 20 | 43264851 | - | GTTCCACCTGCAAGGGGCAGGG | 1 | 1 | 6 | 42 SEQ ID NO. 279 |

FIG. 1 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 20 | 43264852 | - | AGTTCCACCTGCAAGGGGCAGG | 1 | 1 | 41 | SEQ ID NO. 280 |
| (N20)NGG | 20 | 43264856 | - | ATGCAGTTCCACCTGCAAGGGG | 1 | 4 | 33 | SEQ ID NO. 281 |
| (N20)NGG | 20 | 43264857 | - | CATGCAGTTCCACCTGCAAGGG | 1 | 2 | 29 | SEQ ID NO. 282 |
| (N20)NGG | 20 | 43264858 | - | ACATGCAGTTCCACCTGCAAGG | 1 | 1 | 38 | SEQ ID NO. 283 |
| (N20)NGG | 20 | 43264859 | - | GACATGCAGTTCCACCTGCAAGG | 1 | 2 | 51 | SEQ ID NO. 284 |
| (N20)NGG | 20 | 43264881 | - | GCTTGATGGATCCGTCTAGGTGG | 1 | 2 | 5 | SEQ ID NO. 285 |
| (N20)NGG | 20 | 43264884 | - | CAGGCTTGATGGATCCGTCTAGG | 1 | 1 | 5 | SEQ ID NO. 286 |
| (N20)NGG | 20 | 43264895 | - | TAAGATGGTTTCAGGCTTGATGG | 1 | 1 | 26 | SEQ ID NO. 287 |
| (N20)NGG | 20 | 43264903 | - | CCATAGTATAAGATGGTTTCAGG | 1 | 1 | 23 | SEQ ID NO. 288 |
| (N20)NGG | 20 | 43264910 | - | TTACCTGCCATAGTATAAGATGG | 1 | 5 | 28 | SEQ ID NO. 289 |
| (N20)NGG | 20 | 43280218 | + | CGGGGCGCACAGAGGGCACCATGG | 1 | 1 | 14 | SEQ ID NO. 290 |
| (N20)NGG | 20 | 43280261 | + | AAGCCCAAAAGTGAGCGCGCGCGG | 1 | 1 | 7 | SEQ ID NO. 291 |
| (N20)NGG | 20 | 43280262 | + | AGCCCAAAAGTGAGCGCGCGCGGG | 1 | 1 | 4 | SEQ ID NO. 292 |
| (N20)NGG | 20 | 43280263 | + | GCCCAAAAGTGAGCGCGCGCGGGG | 1 | 1 | 8 | SEQ ID NO. 293 |
| (N20)NGG | 20 | 43280264 | + | CCCAAAAGTGAGCGCGCGCGGGGG | 1 | 1 | 11 | SEQ ID NO. 294 |
| (N20)NGG | 20 | 43280270 | + | GTGAGCGCGCGCGGGGCTCCGG | 1 | 3 | 41 | SEQ ID NO. 295 |
| (N20)NGG | 20 | 43280271 | + | TGAGCGCGCGCGGGGCTCCGG | 1 | 3 | 24 | SEQ ID NO. 296 |
| (N20)NGG | 20 | 43280272 | + | GAGCGCGCGCGGGGCTCCGGG | 1 | 3 | 44 | SEQ ID NO. 297 |
| (N20)NGG | 20 | 43280195 | - | CATGGTGCCCTGTGCGCCCGG | 1 | 2 | 15 | SEQ ID NO. 298 |
| (N20)NGG | 20 | 43280213 | - | GAAGGCGGGCGTCTGGGCCATGG | 1 | 2 | 26 | SEQ ID NO. 299 |
| (N20)NGG | 20 | 43280219 | - | CTTGTCGAAGGCGGGCGTCTGG | 1 | 1 | 6 | SEQ ID NO. 300 |
| (N20)NGG | 20 | 43280220 | - | GCTTGTCGAAGGCGGGCGTCGG | 1 | 1 | 9 | SEQ ID NO. 301 |
| (N20)NGG | 20 | 43280227 | - | ACTTTGGGCTTGTCGAAGGCGG | 1 | 2 | 17 | SEQ ID NO. 302 |
| (N20)NGG | 20 | 43280228 | - | CACTTTGGGCTTGTCGAAGGCGG | 1 | 2 | 18 | SEQ ID NO. 303 |
| (N20)NGG | 20 | 43280231 | - | GCTCACTTTGGGCTTGTCGAAGG | 1 | 1 | 21 | SEQ ID NO. 304 |
| (N20)NGG | 20 | 43280242 | - | CCCCGCGGCGCTCACTTTGG | 1 | 1 | 9 | SEQ ID NO. 305 |
| (N20)NGG | 20 | 43280243 | - | GCCCCGCGGCGCTCACTTTGG | 2 | 6 | 11 | SEQ ID NO. 306 |

FIG. 1 cont.

| site_type | site_chr omosome | site_start nucleotide | site_s trand | target site sequence with NGG | genome_wide hits_with_ 1_or_less_m ismatches | genome_wide hits_with_2 _or_less_mism atches | genome_wide hits_with_3 _or_less_mism atches | | |
|---|---|---|---|---|---|---|---|---|---|
| (N20)NGG | 1 | 33476443 | + | TATTTCAGCCTAGTATCAGAAGG | 1 | 2 | 38 | SEQ ID NO. | 307 |
| (N20)NGG | 1 | 33476448 | + | CAGCCTAGTATCAGAAGGCCAGG | 2 | 4 | 49 | SEQ ID NO. | 308 |
| (N20)NGG | 1 | 33476415 | - | GATACTAGGCTGAAATAGAGAGG | 1 | 2 | 28 | SEQ ID NO. | 309 |
| (N20)NGG | 1 | 33476429 | - | TCGCCTGGCCTTCTGATACTAGG | 2 | 3 | 20 | SEQ ID NO. | 310 |
| (N20)NGG | 1 | 33478814 | + | TCTTCCTGTTCTCAGATCACCGG | 4 | 452 | 2834 | SEQ ID NO. | 311 |
| (N20)NGG | 1 | 33478815 | + | CTTCCTGTTCTCAGATCACCGGG | 2 | 5 | 408 | SEQ ID NO. | 312 |
| (N20)NGG | 1 | 33478816 | + | TTCCTGTTCTCAGATCACCGGGG | 1 | 1 | 25 | SEQ ID NO. | 313 |
| (N20)NGG | 1 | 33478852 | + | TCGATCAGATGATAATGAAAAGG | 2 | 3 | 34 | SEQ ID NO. | 314 |
| (N20)NGG | 1 | 33478914 | + | CCCCACTCATAGAGTACTACAGG | 2 | 2 | 8 | SEQ ID NO. | 315 |
| (N20)NGG | 1 | 33478920 | + | TCATAGAGTACTACAGGAAACGG | 2 | 2 | 44 | SEQ ID NO. | 316 |
| (N20)NGG | 1 | 33478921 | + | CATAGAGTACTACAGGAAACGGG | 2 | 2 | 35 | SEQ ID NO. | 317 |
| (N20)NGG | 1 | 33478922 | + | ATAGAGTACTACAGGAAACGGGG | 2 | 2 | 26 | SEQ ID NO. | 318 |
| (N20)NGG | 1 | 33478923 | + | TAGAGTACTACAGGAAACGGGGG | 2 | 3 | 11 | SEQ ID NO. | 319 |
| (N20)NGG | 1 | 33479014 | + | CAAAGCCACATGTAAAGACTTGG | 1 | 6 | 64 | SEQ ID NO. | 320 |
| (N20)NGG | 1 | 33478796 | - | TTCCCGGTGATCTGAGAACAGG | 1 | 1 | 13 | SEQ ID NO. | 321 |
| (N20)NGG | 1 | 33478811 | - | TCGACGGATCAAGGGTTCCCCGG | 2 | 2 | 2 | SEQ ID NO. | 322 |
| (N20)NGG | 1 | 33478819 | - | TCATCTGATCGACGGATCAAGG | 2 | 2 | 4 | SEQ ID NO. | 323 |
| (N20)NGG | 1 | 33478820 | - | ATCATCTGATCGACGGATCAAGG | 2 | 3 | 9 | SEQ ID NO. | 324 |
| (N20)NGG | 1 | 33478827 | - | TTTTCATTATCATCTGATCGACGG | 2 | 3 | 41 | SEQ ID NO. | 325 |
| (N20)NGG | 1 | 33478853 | - | GGCTTGCAGCGGATTTTCAAGG | 1 | 3 | 16 | SEQ ID NO. | 326 |
| (N20)NGG | 1 | 33478863 | - | GAGTGTGGTAGGCTTGCAGGCGG | 2 | 4 | 44 | SEQ ID NO. | 327 |
| (N20)NGG | 1 | 33478866 | - | TTTGAGTGTGGTAGGCTTGCAGG | 2 | 2 | 17 | SEQ ID NO. | 328 |
| (N20)NGG | 1 | 33478874 | - | TGGGGTGGTTTGAGTGTGGTAGG | 2 | 6 | 77 | SEQ ID NO. | 329 |
| (N20)NGG | 1 | 33478878 | - | TGAGTGGGGTGGTTTGAGTGTGG | 2 | 5 | 86 | SEQ ID NO. | 330 |
| (N20)NGG | 1 | 33478889 | - | GTAGTACTCTATGAGTGGGGTGG | 2 | 2 | 15 | SEQ ID NO. | 331 |
| (N20)NGG | 1 | 33478892 | - | CTTGTAGTACTCTATGAGTGGGG | 2 | 2 | 16 | SEQ ID NO. | 332 |
| (N20)NGG | 1 | 33478893 | - | TCCTGTAGTACTCTATGAGTGG | 2 | 3 | 23 | SEQ ID NO. | 333 |
| (N20)NGG | 1 | 33478894 | - | TTCCTGTAGTACTCTATGAGTGG | 1 | 2 | 11 | SEQ ID NO. | 334 |
| (N20)NGG | 1 | 33478926 | - | GGGATGCATCGATGGCGGAGTGG | 2 | 2 | 43 | SEQ ID NO. | 335 |
| (N20)NGG | 1 | 33478931 | - | GGTCTGGGATGCATCGATGGCGG | 1 | 4 | 26 | SEQ ID NO. | 336 |
| (N20)NGG | 1 | 33478934 | - | GGGGGTCTGGGATGCATCGATGG | 2 | 2 | 3 | SEQ ID NO. | 337 |
| (N20)NGG | 1 | 33478946 | - | GAACACGACATCGGGGGTCTGG | 2 | 2 | 3 | SEQ ID NO. | 338 |
| (N20)NGG | 1 | 33478947 | - | CGAACACGACATCGGGGGTCTGG | 2 | 2 | 3 | SEQ ID NO. | 339 |
| (N20)NGG | 1 | 33478952 | - | GCTTGCGAACACGACATCGGGGG | 2 | 2 | 3 | SEQ ID NO. | 340 |
| (N20)NGG | 1 | 33478953 | - | TGCTTGCGAACACGACATCGGGG | 2 | 3 | 4 | SEQ ID NO. | 341 |
| (N20)NGG | 1 | 33478954 | - | ATGCTTGCGAACACGACATCGGG | 2 | 2 | 37 | SEQ ID NO. | 342 |
| (N20)NGG | 1 | 33478955 | - | GATGCTTGCGAACACGACATCGG | 2 | 2 | 5 | SEQ ID NO. | 343 |
| (N20)NGG | 1 | 33478977 | - | TGGCTTTGGAAGGCTGCTAGG | 3 | 9 | 93 | SEQ ID NO. | 344 |

FIG. 2

| site_type | site_chromosome | site_start_nucleotide | site_strand | target site sequence with NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 1 | 33478985 | - | TTTACATGTGGCTTTGAGAAGG | 2 | | 4 | 94 | SEQ ID NO. 345 |
| (N20)NGG | 1 | 33478991 | - | CAAGTCTTTACATGTGGCTTTGG | 2 | | 3 | 39 | SEQ ID NO. 346 |
| (N20)NGG | 1 | 33478997 | - | CATAACCAAGTCTTTACATGTGG | 1 | | 1 | 29 | SEQ ID NO. 347 |
| (N20)NGG | 1 | 33480122 | + | ATATTCATTTGTGTCTTTCAGG | 1 | | 3 | 129 | SEQ ID NO. 348 |
| (N20)NGG | 1 | 33480142 | + | AGGCTGATTCACCCCAAGAGTGG | 1 | | 1 | 23 | SEQ ID NO. 349 |
| (N20)NGG | 1 | 33480159 | + | GAGTGGCCGTTCCTACCACGAGG | 2 | | 2 | 6 | SEQ ID NO. 350 |
| (N20)NGG | 1 | 33480209 | + | AAGATGACGTATGTAAACTCAGG | 1 | | 1 | 11 | SEQ ID NO. 351 |
| (N20)NGG | 1 | 33480131 | - | GGTAGGAACGGCCACTCTTGGGG | 2 | | 2 | 15 | SEQ ID NO. 352 |
| (N20)NGG | 1 | 33480132 | - | TGGTAGGAACGGCCACTCTTGGG | 2 | | 2 | 13 | SEQ ID NO. 353 |
| (N20)NGG | 1 | 33480133 | - | GTGGTAGGAACGGCCACTCTTGG | 2 | | 2 | 62 | SEQ ID NO. 354 |
| (N20)NGG | 1 | 33480143 | - | TGAACTCCTGCGTGGTAGGAACGG | 2 | | 3 | 20 | SEQ ID NO. 355 |
| (N20)NGG | 1 | 33480148 | - | AGGGTTGAACTCCTCGTGGTAGG | 2 | | 2 | 10 | SEQ ID NO. 356 |
| (N20)NGG | 1 | 33480152 | - | TTGGAGGGTTGAACTCCTCGTGG | 2 | | 2 | 11 | SEQ ID NO. 357 |
| (N20)NGG | 1 | 33480167 | - | CTTTCATGGGCTCTTTTGGAGGG | 2 | | 6 | 59 | SEQ ID NO. 358 |
| (N20)NGG | 1 | 33480168 | - | TCTTTCATGGGCTCTTTTGGAGG | 2 | | 4 | 62 | SEQ ID NO. 359 |
| (N20)NGG | 1 | 33480171 | - | TCATCTTTCATGGGCTCTTTTGG | 2 | | 4 | 61 | SEQ ID NO. 360 |
| (N20)NGG | 1 | 33480180 | - | TTACATACGTCATCTTTCATGGG | 1 | | 1 | 28 | SEQ ID NO. 361 |
| (N20)NGG | 1 | 33480181 | - | TTTACATACGTCATCTTTCATGG | 1 | | 3 | 43 | SEQ ID NO. 362 |
| (N20)NGG | 1 | 33486982 | + | TTTCAGCTCGATGACCTCATGG | 1 | | 2 | 15 | SEQ ID NO. 363 |
| (N20)NGG | 1 | 33486990 | + | TCGATGACCTCATGGAGAAGAGG | 3 | | 4 | 27 | SEQ ID NO. 364 |
| (N20)NGG | 1 | 33487058 | + | CTGCTGATCCGAAGAATCACAGG | 2 | | 3 | 23 | SEQ ID NO. 365 |
| (N20)NGG | 1 | 33487062 | + | TGATCCGAAGAATCACAGGAAGG | 2 | | 2 | 27 | SEQ ID NO. 366 |
| (N20)NGG | 1 | 33487079 | + | GGAAGGTATTTGTCCCTTGAAGG | 1 | | 2 | 30 | SEQ ID NO. 367 |
| (N20)NGG | 1 | 33486949 | - | TCGAGCTGTAAAAGAATGTGTGG | 1 | | 1 | 22 | SEQ ID NO. 368 |
| (N20)NGG | 1 | 33486975 | - | TCTCTTTTCCTCTTCTCCATGAGG | 4 | | 20 | 282 | SEQ ID NO. 369 |
| (N20)NGG | 1 | 33487026 | - | TTCGGATCAGCAGAGAGTCTGGG | 2 | | 4 | 14 | SEQ ID NO. 370 |
| (N20)NGG | 1 | 33487027 | - | CTTCGGATCAGCAGAGAGTCTGG | 2 | | 3 | 16 | SEQ ID NO. 371 |
| (N20)NGG | 1 | 33487044 | - | AATACCTTCCTGTAACTTCCAGG | 1 | | 5 | 70 | SEQ ID NO. 372 |
| (N20)NGG | 1 | 33487193 | + | CTATTTTGTTCCTAACTTCCAGG | 1 | | 2 | 84 | SEQ ID NO. 373 |
| (N20)NGG | 1 | 33487208 | + | CTTCCAGGTGAGTGATGAAATGG | 1 | | 6 | 75 | SEQ ID NO. 374 |
| (N20)NGG | 1 | 33487214 | + | GGTGAGTGATGAAATGGTAGTGG | 3 | | 5 | 43 | SEQ ID NO. 375 |
| (N20)NGG | 1 | 33487235 | + | GGAGCTCATTGAAGAAGAATTTGG | 3 | | 4 | 77 | SEQ ID NO. 376 |
| (N20)NGG | 1 | 33487257 | + | GAGACCCCCTTGTGCAAAAATGG | 2 | | 4 | 39 | SEQ ID NO. 377 |
| (N20)NGG | 1 | 33487268 | + | GTGCAAAAATGGTTTTCTTCTGG | 3 | | 7 | 58 | SEQ ID NO. 378 |
| (N20)NGG | 1 | 33487272 | + | AAAAATGGTTTTCTTCTGGATGG | 3 | | 8 | 176 | SEQ ID NO. 379 |
| (N20)NGG | 1 | 33487282 | + | TTCTTCTGGATGGCTTCCCTCGG | 3 | | 18 | 115 | SEQ ID NO. 380 |
| (N20)NGG | 1 | 33487291 | + | ATGGCTTCCCTCGGACTGTGAGG | 3 | | 4 | 29 | SEQ ID NO. 381 |
| (N20)NGG | 1 | 33487295 | + | CTTCCCTCGGACTGTGAGGCAGG | 3 | | 5 | 27 | SEQ ID NO. 382 |

FIG. 2 cont.

| site type | site_chr onosome | site_start_ nucleotide | site_s trand | target site sequence with NGG | genome_wide_ hits_with_ 1_or_less_m ismatches | genome_wide_ hits_with_2_ or_less_mism atches | genome_wide_ hits_with_3_ or_less_mism atches | | |
|---|---|---|---|---|---|---|---|---|---|
| (N20)NGG | 1 | 33487304 | + | GACTGTGAGGCAGGCAGAAATGG | 3 | 3 | 13 | 146 | SEQ ID NO. 383 |
| (N20)NGG | 1 | 33487307 | + | TGTGAGGCAGGCAGAAATGGTGG | | 1 | 19 | 158 | SEQ ID NO. 384 |
| (N20)NGG | 1 | 33487308 | + | GTGAGGCAGGCAGAAATGGTGGG | | 1 | 6 | 94 | SEQ ID NO. 385 |
| (N20)NGG | 1 | 33487181 | - | TCATCACTCACCTGGAAGTTAGG | 1 | 1 | 3 | 50 | SEQ ID NO. 386 |
| (N20)NGG | 1 | 33487189 | - | CTACCATTTCATCACTCACCTGG | | 4 | 5 | 32 | SEQ ID NO. 387 |
| (N20)NGG | 1 | 33487239 | - | AAAACCATTTTGCACAAGGGGG | | 3 | 5 | 70 | SEQ ID NO. 388 |
| (N20)NGG | 1 | 33487240 | - | GAAACCATTTTGCACAAGGGG | | 3 | 5 | 73 | SEQ ID NO. 389 |
| (N20)NGG | 1 | 33487241 | - | AGAAAACCATTTTGCACAAGGG | 3 | 3 | 12 | 122 | SEQ ID NO. 390 |
| (N20)NGG | 1 | 33487242 | - | AAGAAAACCATTTTGCACAAGG | | 3 | 6 | 134 | SEQ ID NO. 391 |
| (N20)NGG | 1 | 33487276 | - | CTGCCTGCCTCACAGTCCGAGG | | 3 | 14 | 388 | SEQ ID NO. 392 |
| (N20)NGG | 1 | 33487277 | - | TCTGCCTGCCTCACAGTCCAGG | | 3 | 8 | 84 | SEQ ID NO. 393 |
| (N20)NGG | 1 | 33490042 | + | GTTTTTGTCTTCCTCTCTGTAGG | | 1 | 18 | 183 | SEQ ID NO. 394 |
| (N20)NGG | 1 | 33490054 | + | CTCTCTGTAGGCACCCAGATTGG | | 1 | 2 | 25 | SEQ ID NO. 395 |
| (N20)NGG | 1 | 33490088 | + | TGTGTCTGCCATTTAGCTACTGG | | 2 | 6 | 41 | SEQ ID NO. 396 |
| (N20)NGG | 1 | 33490089 | + | GTGTCTGCCATTTAGCTACTGGG | | 2 | 7 | 36 | SEQ ID NO. 397 |
| (N20)NGG | 1 | 33490090 | + | TGTCTGCCATTTAGCTACTGGGG | | 3 | 4 | 44 | SEQ ID NO. 398 |
| (N20)NGG | 1 | 33490101 | + | TAGCTACTGGGGACATGCTGAGG | | 2 | 3 | 37 | SEQ ID NO. 399 |
| (N20)NGG | 1 | 33490102 | + | AGCTACTGGGGACATGCTGAGGG | | 2 | 4 | 51 | SEQ ID NO. 400 |
| (N20)NGG | 1 | 33490108 | + | TGGGGACATGCTGAGGGCCATGG | | 3 | 8 | 96 | SEQ ID NO. 401 |
| (N20)NGG | 1 | 33490111 | + | GGACATGCTGAGGGCCATGGTGG | | 3 | 6 | 74 | SEQ ID NO. 402 |
| (N20)NGG | 1 | 33490118 | + | CTGAGGGCCATGGTGCCTTCTGG | | 4 | 12 | 93 | SEQ ID NO. 403 |
| (N20)NGG | 1 | 33490130 | + | GTGGCTTCTGGCTCAGAGCTAGG | | 4 | 8 | 79 | SEQ ID NO. 404 |
| (N20)NGG | 1 | 33490144 | + | AGAGCTAGGAAAAAAGCTGAAGG | | 2 | 6 | 111 | SEQ ID NO. 405 |
| (N20)NGG | 1 | 33490153 | + | AAAAAAGCTGAAGGCAACTATGG | | 1 | 5 | 175 | SEQ ID NO. 406 |
| (N20)NGG | 1 | 33490160 | + | CTGAAGGCAACTATGATGCTGG | | 1 | 3 | 27 | SEQ ID NO. 407 |
| (N20)NGG | 1 | 33490161 | + | TGAAGGCAACTATGATGCTGGG | | 3 | 4 | 32 | SEQ ID NO. 408 |
| (N20)NGG | 1 | 33490168 | + | AACTATGGATGCTGGGAAACTGG | | 3 | 8 | 44 | SEQ ID NO. 409 |
| (N20)NGG | 1 | 33490172 | + | ATGGATGCTGGGAAACTGGTAGG | | 3 | 4 | 72 | SEQ ID NO. 410 |
| (N20)NGG | 1 | 33490177 | + | TGCTGGGAAACTGGTAGGTTTGG | | 2 | 1 | 41 | SEQ ID NO. 411 |
| (N20)NGG | 1 | 33490180 | + | TGGGAAACTGGTAGGTTTGGTGG | | 4 | 3 | 43 | SEQ ID NO. 412 |
| (N20)NGG | 1 | 33490031 | - | CAATCTGGTGCCTACAGAGAGG | | 1 | 1 | 22 | SEQ ID NO. 413 |
| (N20)NGG | 1 | 33490045 | - | CAGAAGTTTTCAGCCAATCTGG | | 3 | 4 | 65 | SEQ ID NO. 414 |
| (N20)NGG | 1 | 33490046 | - | ACAGAAGTTTTCAGCCAATCTG | | 3 | 8 | 40 | SEQ ID NO. 415 |
| (N20)NGG | 1 | 33490074 | - | GCATGTCCCAGTAGCTAAATGG | | 2 | 4 | 24 | SEQ ID NO. 416 |
| (N20)NGG | 1 | 33490103 | - | CTCTGAGCCAGAAGCCACCATGG | | 5 | 13 | 113 | SEQ ID NO. 417 |
| (N20)NGG | 1 | 33502333 | + | GTGCAGTGAGAGACTTCGGCGG | | 2 | 4 | 28 | SEQ ID NO. 418 |
| (N20)NGG | 1 | 33502339 | + | GTGAGAGACTTCGGCGGACATGG | | 2 | 3 | 8 | SEQ ID NO. 419 |
| (N20)NGG | 1 | 33502357 | + | CATGCTCCCAGCGTGCCAGCGG | | 3 | 6 | 37 | SEQ ID NO. 420 |

FIG. 2 cont.

| site_type | site_chr omosome | site_start nucleotide | site_s trand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 1 | 33502379 | + | GCAGAACCCGAGTATCCTAAAGG | 3 | 3 | 19 | SEQ ID NO. 421 |
| (N20)NGG | 1 | 33502386 | + | CCGAGTATCCTAAAGGCATCCGG |  | 4 | 9 | SEQ ID NO. 422 |
| (N20)NGG | 1 | 33502387 | + | CGAGTATCCTAAAGGCATCCGGG | 2 | 2 | 10 | SEQ ID NO. 423 |
| (N20)NGG | 1 | 33502399 | + | AGGCATCCGGGCCGTGCTGCTGG | 2 | 2 | 13 | SEQ ID NO. 424 |
| (N20)NGG | 1 | 33502400 | + | GGCATCCGGGCCGTGCTGCTGGG | 2 | 2 | 12 | SEQ ID NO. 425 |
| (N20)NGG | 1 | 33502401 | + | GCATCCGGGCCGTGCTGCTGGGG | 2 | 3 | 22 | SEQ ID NO. 426 |
| (N20)NGG | 1 | 33502409 | + | GCCGTGCTGCTGGGGCCTCCCGG | 3 | 5 | 80 | SEQ ID NO. 427 |
| (N20)NGG | 1 | 33502410 | + | CCGTGCTGCTGGGGCCTCCCGGG | 3 | 14 | 165 | SEQ ID NO. 428 |
| (N20)NGG | 1 | 33502411 | + | CGTGCTGCTGGGGCCTCCCGGGG | 2 | 3 | 50 | SEQ ID NO. 429 |
| (N20)NGG | 1 | 33502415 | + | CTGCTGGGGCCTCCCGGGGCCGG | 3 | 27 | 142 | SEQ ID NO. 430 |
| (N20)NGG | 1 | 33502421 | + | GGGCCTCCCGGGGCCGGTAAAGG | 3 | 5 | 22 | SEQ ID NO. 431 |
| (N20)NGG | 1 | 33502422 | + | GGCCTCCCGGGGCCGGTAAAGGG | 1 | 3 | 15 | SEQ ID NO. 432 |
| (N20)NGG | 1 | 33502429 | + | CGGGGCCGGTAAAGGGACCCAGG | 1 | 3 | 11 | SEQ ID NO. 433 |
| (N20)NGG | 1 | 33502436 | + | GGTAAAGGGACCCAGGTGAGCGG | 1 | 3 | 55 | SEQ ID NO. 434 |
| (N20)NGG | 1 | 33502440 | + | AAGGGACCCAGGTGAGCGCAGG | 1 | 1 | 29 | SEQ ID NO. 435 |
| (N20)NGG | 1 | 33502445 | + | ACCCAGGTGAGCGCAGGACTGG | 1 | 3 | 43 | SEQ ID NO. 436 |
| (N20)NGG | 1 | 33502446 | + | CCCAGGTGAGCGGCAGGACTGGG | 1 | 7 | 55 | SEQ ID NO. 437 |
| (N20)NGG | 1 | 33502451 | + | GTGAGCGGCAGGACTGGGCTTGG | 1 | 5 | 101 | SEQ ID NO. 438 |
| (N20)NGG | 1 | 33502342 | - | GGTTCTGCCGCTGGCACGCTGGG | 3 | 3 | 16 | SEQ ID NO. 439 |
| (N20)NGG | 1 | 33502343 | - | GGGTTCTGCCGCTGGCACGCTGG | 3 | 3 | 14 | SEQ ID NO. 440 |
| (N20)NGG | 1 | 33502351 | - | GGATACTCGGGTTCTGCCGCTGG | 3 | 3 | 9 | SEQ ID NO. 441 |
| (N20)NGG | 1 | 33502363 | - | CGGATGCCTTTAGGATACTCGGG | 2 | 2 | 11 | SEQ ID NO. 442 |
| (N20)NGG | 1 | 33502364 | - | CCGGATGCCTTTAGGATACTCGG | 2 | 3 | 12 | SEQ ID NO. 443 |
| (N20)NGG | 1 | 33502372 | - | AGCACGGCCCGGATGCCTTTAGG | 2 | 2 | 17 | SEQ ID NO. 444 |
| (N20)NGG | 1 | 33502383 | - | GAGGCCCCAGCAGCACGGCCCGG | 3 | 7 | 90 | SEQ ID NO. 445 |
| (N20)NGG | 1 | 33502388 | - | CCCGGAGGCCCCAGCAGCACGG | 3 | 9 | 114 | SEQ ID NO. 446 |
| (N20)NGG | 1 | 33502402 | - | GTCCCTTTACCGGCCCCGGGAGG | 1 | 3 | 13 | SEQ ID NO. 447 |
| (N20)NGG | 1 | 33502405 | - | TGGGTCCCTTTACCGGCCCCGGG | 1 | 6 | 19 | SEQ ID NO. 448 |
| (N20)NGG | 1 | 33502406 | - | CTGGGTCCCTTTACCGGCCCCGG | 2 | 4 | 16 | SEQ ID NO. 449 |
| (N20)NGG | 1 | 33502412 | - | GCTCACCTGGGTCCCTTTACCGG | 1 | 2 | 24 | SEQ ID NO. 450 |
| (N20)NGG | 1 | 33502424 | - | CCCAGTCCTGCCGCTCACCTGGG | 2 | 7 | 62 | SEQ ID NO. 451 |
| (N20)NGG | 1 | 33502425 | - | GCCCAGTCCTGCCGCTCACCTGG |  | 1 | 46 | SEQ ID NO. 452 |

FIG. 2 cont.

| site_type | site_chr omosome | site_start_ nucleotide | site_s trand | target_site_sequence_wit h_NGG | genome_wide_ hits_with_1_ or_less_mism atches | genome_wide_ hits_with_2_ or_less_mism atches | genome_wide_ hits_with_3_ or_less_mism atches | |
|---|---|---|---|---|---|---|---|---|
| (N20)NGG | 11 | 118209916 | + | GATGCTCAGTACAGCCACCTTGG | 1 | 1 | 32 | SEQ ID NO. 453 |
| (N20)NGG | 11 | 118209919 | + | GCTCAGTACAGCCACCTTGGAGG | 1 | 4 | 47 | SEQ ID NO. 454 |
| (N20)NGG | 11 | 118209926 | + | ACAGCCACCTTGGAGGAAACTGG | 1 | 3 | 56 | SEQ ID NO. 455 |
| (N20)NGG | 11 | 118209927 | + | CAGCCACCTTGGAGGAAACTGGG | 1 | 6 | 70 | SEQ ID NO. 456 |
| (N20)NGG | 11 | 118209932 | + | ACCTTGGAGGAAACTGGGCTCGG | 1 | 7 | 61 | SEQ ID NO. 457 |
| (N20)NGG | 11 | 118209953 | + | GGAACAGTGAACCTGAGACTGG | 1 | 1 | 31 | SEQ ID NO. 458 |
| (N20)NGG | 11 | 118209956 | + | ACAAGTGAACCTGAGACTGGTGG | 1 | 1 | 29 | SEQ ID NO. 459 |
| (N20)NGG | 11 | 118209852 | - | TAAGAGAGGAGAAGAGAAAACG | 6 | 116 | 1279 | SEQ ID NO. 460 |
| (N20)NGG | 11 | 118209866 | - | GATCTCCGAGGGGCTAAGAGAGG | 1 | 2 | 45 | SEQ ID NO. 461 |
| (N20)NGG | 11 | 118209876 | - | GCATCATCTCGATCTCCGAGGGG | 1 | 1 | 9 | SEQ ID NO. 462 |
| (N20)NGG | 11 | 118209877 | - | AGCATCATCTCGATCTCCGAGGG | 1 | 1 | 5 | SEQ ID NO. 463 |
| (N20)NGG | 11 | 118209878 | - | GAGCATCATCTCGATCTCGAGG | 1 | 1 | 4 | SEQ ID NO. 464 |
| (N20)NGG | 11 | 118209881 | - | ACTGAGCATCATCTCGATCTCGG | 1 | 2 | 10 | SEQ ID NO. 465 |
| (N20)NGG | 11 | 118209908 | - | GAGCCCAGTTTCCTCCAAGGTGG | 1 | 4 | 48 | SEQ ID NO. 466 |
| (N20)NGG | 11 | 118209911 | - | TCCGAGCCCAGTTTCCTCCAAGG | 1 | 3 | 44 | SEQ ID NO. 467 |
| (N20)NGG | 11 | 118209943 | - | TTCTAGAAGCCACCAGTCTCAGG | 1 | 6 | 53 | SEQ ID NO. 468 |
| (N20)NGG | 11 | 118210190 | + | CCGACACACAAGCTCTGTTGAGG | 1 | 1 | 13 | SEQ ID NO. 469 |
| (N20)NGG | 11 | 118210200 | + | AGCTCTGTTGAGGAATGACCAGG | 1 | 3 | 27 | SEQ ID NO. 470 |
| (N20)NGG | 11 | 118210209 | + | GAGGAATGACCAGGTCTATCAGG | 1 | 1 | 23 | SEQ ID NO. 471 |
| (N20)NGG | 11 | 118210221 | + | GGTCTATCAGGTGAGCGTTGAGG | 1 | 1 | 10 | SEQ ID NO. 472 |
| (N20)NGG | 11 | 118210222 | + | GTCTATCAGGTGAGCGTTGAGGG | 1 | 1 | 15 | SEQ ID NO. 473 |
| (N20)NGG | 11 | 118210223 | + | TCTATCAGGTGAGCGTTGAGGGG | 1 | 2 | 18 | SEQ ID NO. 474 |
| (N20)NGG | 11 | 118210227 | + | TCAGGTGAGCGTTGAGGGGAAGG | 1 | 8 | 42 | SEQ ID NO. 475 |
| (N20)NGG | 11 | 118210230 | + | GGTGAGCGTTGAGGGGAAGGAGG | 1 | 4 | 95 | SEQ ID NO. 476 |
| (N20)NGG | 11 | 118210168 | - | CCTCAACAGCTCACCTGATAGACCTGG | 1 | 4 | 26 | SEQ ID NO. 477 |
| (N20)NGG | 11 | 118210196 | - | CAACGCTCACCTGATAGACCTGG | 1 | 3 | 11 | SEQ ID NO. 478 |
| (N20)NGG | 11 | 118210506 | + | CACAGTGTGCCAGAGCTGTGTGG | 1 | 12 | 110 | SEQ ID NO. 479 |
| (N20)NGG | 11 | 118210512 | + | GTGCCAGAGCTGTGTGGAGCTGG | 1 | 6 | 58 | SEQ ID NO. 480 |
| (N20)NGG | 11 | 118210527 | + | GGAGCTGGATCCAGCCACCGTGG | 1 | 3 | 32 | SEQ ID NO. 481 |
| (N20)NGG | 11 | 118210531 | + | CTGGATCCAGCCACCGTGGCTGG | 1 | 2 | 43 | SEQ ID NO. 482 |
| (N20)NGG | 11 | 118210575 | + | TGCCACTCTGCTCCTTGCTTTGG | 2 | 5 | 71 | SEQ ID NO. 483 |
| (N20)NGG | 11 | 118210576 | + | GCCACTCTGCTCCTTGCTTTGGG | 1 | 3 | 60 | SEQ ID NO. 484 |
| (N20)NGG | 11 | 118210594 | + | TTGGGAGTCTTTCTGCTTTGCTGG | 1 | 2 | 44 | SEQ ID NO. 485 |

FIG. 3

| site_type | site_chr omosome | site_start nucleotide | site_s trand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 118210606 | + | TGCTTTGCTGGACATGAGACTGG | 1 | 2 | 47 | SEQ ID NO. 486 |
| (N20)NGG | 11 | 118210610 | + | TTGCTGGACATGAGACTGGAAGG | 1 | 5 | 66 | SEQ ID NO. 487 |
| (N20)NGG | 11 | 118210618 | + | CATGAGACTGGAAGGCTGTCTGG | 1 | 2 | 38 | SEQ ID NO. 488 |
| (N20)NGG | 11 | 118210619 | + | ATGAGACTGGAAGGCTGTCTGGG | 1 | 4 | 51 | SEQ ID NO. 489 |
| (N20)NGG | 11 | 118210620 | + | TGAGACTGGAAGGCTGTCTGGGG | 1 | 4 | 76 | SEQ ID NO. 490 |
| (N20)NGG | 11 | 118210621 | + | GAGACTGGAAGGCTGTCTGGGGG | 1 | 7 | 78 | SEQ ID NO. 491 |
| (N20)NGG | 11 | 118210628 | + | GAAGGCTGTCTGGGGTTAGTGG | 1 | 4 | 51 | SEQ ID NO. 492 |
| (N20)NGG | 11 | 118210465 | - | TGTGGGGAAGGGAGGAGAGAGAG | 9 | 73 | 815 | SEQ ID NO. 493 |
| (N20)NGG | 11 | 118210472 | - | GGCACACTGTGGGGGAAGGGAGG | 1 | 7 | 129 | SEQ ID NO. 494 |
| (N20)NGG | 11 | 118210475 | - | CTGGCACACTGTGGGGGAAGG | 1 | 4 | 46 | SEQ ID NO. 495 |
| (N20)NGG | 11 | 118210476 | - | CTCTGGCACACTGTGGGGGAAGG | 1 | 1 | 51 | SEQ ID NO. 496 |
| (N20)NGG | 11 | 118210480 | - | ACAGCTCTGGCACACTGTGGGG | 1 | 7 | 59 | SEQ ID NO. 497 |
| (N20)NGG | 11 | 118210481 | - | CACAGCTCTGGCACACTGTGGG | 1 | 4 | 70 | SEQ ID NO. 498 |
| (N20)NGG | 11 | 118210482 | - | ACACAGCTCTGGCACACTGTGG | 2 | 6 | 59 | SEQ ID NO. 499 |
| (N20)NGG | 11 | 118210483 | - | CACACAGCTCTGGCACACTGTGG | 2 | 9 | 112 | SEQ ID NO. 500 |
| (N20)NGG | 11 | 118210493 | - | GATCCAGCTCCACACAGCTCTGG | 1 | 4 | 45 | SEQ ID NO. 501 |
| (N20)NGG | 11 | 118210515 | - | ATGATGCCAGCCACGGTGGCTGG | 1 | 2 | 54 | SEQ ID NO. 502 |
| (N20)NGG | 11 | 118210519 | - | GACAATGATGCCAGCCACGGTGG | 1 | 5 | 65 | SEQ ID NO. 503 |
| (N20)NGG | 11 | 118210522 | - | AGTGACAATGATGCCAGCCACGG | 1 | 3 | 47 | SEQ ID NO. 504 |
| (N20)NGG | 11 | 118210555 | - | TCCCAAAGCAAGGAGCAGAGTGG | 1 | 8 | 105 | SEQ ID NO. 505 |
| (N20)NGG | 11 | 118210565 | - | AGCAGAAGACTCCCAAAGCAAGG | 1 | 7 | 54 | SEQ ID NO. 506 |
| (N20)NGG | 11 | 118211115 | + | CCCCTTCAAGATACCTATAGAGG | 1 | 2 | 22 | SEQ ID NO. 507 |
| (N20)NGG | 11 | 118211124 | + | GATACCTATAGAGGAACTTGAGG | 1 | 1 | 15 | SEQ ID NO. 508 |
| (N20)NGG | 11 | 118211162 | + | ATTGCAATACCAGCATCACATGG | 1 | 4 | 44 | SEQ ID NO. 509 |
| (N20)NGG | 11 | 118211163 | + | TTGCAATACCAGCATCACATGGG | 1 | 1 | 32 | SEQ ID NO. 510 |
| (N20)NGG | 11 | 118211169 | + | TACCAGCATCACATGGGTAGAGG | 1 | 4 | 70 | SEQ ID NO. 511 |
| (N20)NGG | 11 | 118211170 | + | ACCAGCATCACATGGGTAGAGGG | 1 | 2 | 37 | SEQ ID NO. 512 |
| (N20)NGG | 11 | 118211175 | + | CATCACATGGGTAGAGGGAACGG | 1 | 4 | 69 | SEQ ID NO. 513 |
| (N20)NGG | 11 | 118211178 | + | CACATGGGTAGAGGGAACGGTGG | 1 | 2 | 38 | SEQ ID NO. 514 |
| (N20)NGG | 11 | 118211179 | + | ACATGGGTAGAGGGAACGGTGGG | 1 | 3 | 29 | SEQ ID NO. 515 |
| (N20)NGG | 11 | 118211208 | + | GCTCTCAGACATTACAAGACTGG | 1 | 4 | 31 | SEQ ID NO. 516 |
| (N20)NGG | 11 | 118211214 | + | AGACATTACAAGACTGGACCTGG | 1 | 1 | 27 | SEQ ID NO. 517 |
| (N20)NGG | 11 | 118211215 | + | GACATTACAAGACTGGACCTGGG | 1 | 1 | 18 | SEQ ID NO. 518 |

FIG. 3 cont.

| site type | site chr omosome | site start nucleotide | site strand | target_site_sequence_with NGG | genome_wide_hits_with_1_mism or_less mism atches | genome_wide_hits_with_2_mism or_less mism atches | genome_wide_hits_with_3_mism or_less mism atches | |
|---|---|---|---|---|---|---|---|---|
| (N20)NGG | 11 | 118211229 | + | GGACCTGGGAAAACGCATCCTGG | 1 | 1 | 17 | SEQ ID NO. 519 |
| (N20)NGG | 11 | 118211239 | + | AAACGCATCCTGACCCACGAGG | 1 | 1 | 5 | SEQ ID NO. 520 |
| (N20)NGG | 11 | 118211249 | + | TGGACCCACGAGGAATATATAGG | 1 | 2 | 13 | SEQ ID NO. 521 |
| (N20)NGG | 11 | 118211257 | + | CGAGGAATATATAGGTGTAATGG | 1 | 1 | 22 | SEQ ID NO. 522 |
| (N20)NGG | 11 | 118211258 | + | GAGGAATATATAGGTGTAATGGG | 1 | 1 | 51 | SEQ ID NO. 523 |
| (N20)NGG | 11 | 118211274 | + | TAATGGGACAGATATATACAAGG | 1 | 9 | 142 | SEQ ID NO. 524 |
| (N20)NGG | 11 | 118211331 | + | TACGTGCTTCCTGAACCCTTTGG | 1 | 2 | 14 | SEQ ID NO. 525 |
| (N20)NGG | 11 | 118211332 | + | ACGTGCTTCCTGAACCCTTTGGG | 1 | 1 | 17 | SEQ ID NO. 526 |
| (N20)NGG | 11 | 118211080 | - | CTTGAAGGGGCTCACTAAAGGGG | 1 | 1 | 20 | SEQ ID NO. 527 |
| (N20)NGG | 11 | 118211081 | - | TCTTGAAGGGGCTCACTAAAGG | 1 | 2 | 23 | SEQ ID NO. 528 |
| (N20)NGG | 11 | 118211082 | - | ATCTTGAAGGGGCTCACTAAAGG | 1 | 2 | 15 | SEQ ID NO. 529 |
| (N20)NGG | 11 | 118211093 | - | CCTCTATAGGTATCTTGAAGGGG | 1 | 1 | 18 | SEQ ID NO. 530 |
| (N20)NGG | 11 | 118211094 | - | TCCTCTATAGGTATCTTGAAGGG | 1 | 3 | 21 | SEQ ID NO. 531 |
| (N20)NGG | 11 | 118211095 | - | TTCCTCTATAGGTATCTTGAAGG | 1 | 1 | 33 | SEQ ID NO. 532 |
| (N20)NGG | 11 | 118211106 | - | CTGTCCTCAAGTTCCTCTATAGG | 1 | 3 | 35 | SEQ ID NO. 533 |
| (N20)NGG | 11 | 118211149 | - | TCCCTCTACCCATGTGATGCTGG | 1 | 1 | 54 | SEQ ID NO. 534 |
| (N20)NGG | 11 | 118211210 | - | GGTCCAGGATGCGTTTTCCCAGG | 1 | 3 | 19 | SEQ ID NO. 535 |
| (N20)NGG | 11 | 118211225 | - | TATATATTCCTCGTGGGTCCAGG | 1 | 1 | 11 | SEQ ID NO. 536 |
| (N20)NGG | 11 | 118211231 | - | TACACCTATATATTCCTCGTGGG | 1 | 1 | 9 | SEQ ID NO. 537 |
| (N20)NGG | 11 | 118211232 | - | TTACACCTATATATTCCTCGTGG | 1 | 2 | 34 | SEQ ID NO. 538 |
| (N20)NGG | 11 | 118211287 | - | ACTTCGATAATGAACTTGCACGG | 2 | 1 | 14 | SEQ ID NO. 539 |
| (N20)NGG | 11 | 118213264 | + | TCTACTGGATGAGTTCCGCTGGG | 1 | 1 | 9 | SEQ ID NO. 540 |
| (N20)NGG | 11 | 118213270 | + | GGATGAGTTCCGCTGGGAGATGG | 1 | 3 | 31 | SEQ ID NO. 541 |
| (N20)NGG | 11 | 118213292 | + | GAACATAGCACGTTTCTCTCTGG | 1 | 1 | 17 | SEQ ID NO. 542 |
| (N20)NGG | 11 | 118213297 | + | TAGCACGTTTCTCTCTGGCCTGG | 1 | 4 | 39 | SEQ ID NO. 543 |
| (N20)NGG | 11 | 118213303 | + | GTTTCTCTCTGGCCTGGTACTGG | 1 | 2 | 19 | SEQ ID NO. 544 |
| (N20)NGG | 11 | 118213322 | + | CTGACTACCCTTCTCTCGCAAGG | 2 | 5 | 27 | SEQ ID NO. 545 |
| (N20)NGG | 11 | 118213327 | + | TACCCTTCTCTCGCAAGGTAAGG | 1 | 2 | 12 | SEQ ID NO. 546 |
| (N20)NGG | 11 | 118213337 | + | TCGCAAGGTAAGGCTACTCCAGG | 1 | 1 | 4 | SEQ ID NO. 547 |
| (N20)NGG | 11 | 118213340 | + | CAAGGTAAGGCTACTCCAGGTGG | 1 | 2 | 30 | SEQ ID NO. 548 |
| (N20)NGG | 11 | 118213341 | + | AAGGTAAGGCTACTCCAGGTGGG | 1 | 2 | 29 | SEQ ID NO. 549 |
| (N20)NGG | 11 | 118213344 | + | GTAAGGCTACTCCAGGTGGGTGG | 1 | 3 | 26 | SEQ ID NO. 550 |
| (N20)NGG | 11 | 118213345 | + | TAAGGCTACTCCAGGTGGGTGGG | 1 | 2 | 24 | SEQ ID NO. 551 |

FIG. 3 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 118213346 | + | AAGGCTACTCCAGGTGGGTCGGG | 1 | 2 | 27 | SEQ ID NO. 552 |
| (N20)NGG | 11 | 118213257 | - | TGCTATGTTCCATCTCCCAGCGG | 1 | 4 | 57 | SEQ ID NO. 553 |
| (N20)NGG | 11 | 118213293 | - | AGAGAAGGGTAGCCAGTACCAGG | 1 | 4 | 38 | SEQ ID NO. 554 |
| (N20)NGG | 11 | 118213307 | - | AGCCTTACCTTGCGAGAAGGG | 1 | 1 | 14 | SEQ ID NO. 555 |
| (N20)NGG | 11 | 118213308 | - | TAGCCTTACCTTGCGAGAGAAGG | 1 | 1 | 9 | SEQ ID NO. 556 |

FIG. 3 cont.

| site_type | site_chr omosome | site_start_ nucleotide | site_s trand | target_site_sequence_wi th_NGG | genome_wide_ hits_with_1_ or_less_mism atches | genome_wide_ hits_with_2_ or_less_mism atches | genome_wide_ hits_with_3_ or_less_mism atches | |
|---|---|---|---|---|---|---|---|---|
| (N20)NGG | 10 | 14950408 | + | CTGTTTTGTTTGTCCACAGAGG | 3 | 7 | 100 | SEQ ID NO. 557 |
| (N20)NGG | 10 | 14950411 | + | TTTTGTTTGTCCCACAGAGAGG | 1 | 8 | 95 | SEQ ID NO. 558 |
| (N20)NGG | 10 | 14950455 | + | ATCCTCTGCCAATACCTTTAAGG | 1 | 4 | 37 | SEQ ID NO. 559 |
| (N20)NGG | 10 | 14950474 | + | AAGGCACAAAGTTCCATACCCGG | 1 | 1 | 31 | SEQ ID NO. 560 |
| (N20)NGG | 10 | 14950492 | + | CCCGAAACTTTTCACCCTGAGG | 1 | 2 | 12 | SEQ ID NO. 561 |
| (N20)NGG | 10 | 14950550 | + | GAAAACTGAGACAAACCCCAGG | 1 | 6 | 60 | SEQ ID NO. 562 |
| (N20)NGG | 10 | 14950640 | + | AGTGAAAGTGAAGAAGAAGTAGG | 1 | 14 | 197 | SEQ ID NO. 563 |
| (N20)NGG | 10 | 14950661 | + | GGAATCCCAGCTTCACTGCAAGG | 1 | 3 | 67 | SEQ ID NO. 564 |
| (N20)NGG | 10 | 14950669 | + | AGCTTCACTGCAAGGAGATCTGG | 1 | 2 | 28 | SEQ ID NO. 565 |
| (N20)NGG | 10 | 14950670 | + | GCTTCACTGCAAGGAGATCTGGG | 1 | 4 | 40 | SEQ ID NO. 566 |
| (N20)NGG | 10 | 14950693 | + | CTCTGTACTTCACCTGCAAAAGG | 1 | 3 | 51 | SEQ ID NO. 567 |
| (N20)NGG | 10 | 14950700 | + | CTTCACCTGCAAAAGGCTGATGG | 1 | 2 | 53 | SEQ ID NO. 568 |
| (N20)NGG | 10 | 14950701 | + | TTCACCTGCAAAAGGCTGATGGG | 1 | 4 | 44 | SEQ ID NO. 569 |
| (N20)NGG | 10 | 14950702 | + | TCACCTGCAAAAGGCTGATGGGG | 1 | 5 | 52 | SEQ ID NO. 570 |
| (N20)NGG | 10 | 14950716 | + | CTGATGGGGATGTACCCCAGTGG | 1 | 2 | 23 | SEQ ID NO. 571 |
| (N20)NGG | 10 | 14950717 | + | TGATGGGGATGTACCCCAGTGGG | 1 | 1 | 21 | SEQ ID NO. 572 |
| (N20)NGG | 10 | 14950762 | + | TGAAATCACAGATGAGAGTTTGG | 2 | 4 | 66 | SEQ ID NO. 573 |
| (N20)NGG | 10 | 14950786 | + | AAACTTCCCTTCCTCCACAGTGG | 1 | 4 | 85 | SEQ ID NO. 574 |
| (N20)NGG | 10 | 14950790 | + | TTCCCTTCCTCCACAGTGGCAGG | 1 | 7 | 90 | SEQ ID NO. 575 |
| (N20)NGG | 10 | 14950791 | + | TCCCCTTCCTCCACAGTGGCAGGG | 1 | 6 | 83 | SEQ ID NO. 576 |
| (N20)NGG | 10 | 14950792 | + | CCCTTCCTCCACAGTGGCAGGGG | 1 | 8 | 112 | SEQ ID NO. 577 |
| (N20)NGG | 10 | 14950793 | + | CCTTCCTCCACAGTGGCAGGGGG | 3 | 8 | 98 | SEQ ID NO. 578 |
| (N20)NGG | 10 | 14950829 | + | AAGCTTTTCAGTGACTCTGATGG | 1 | 3 | 63 | SEQ ID NO. 579 |
| (N20)NGG | 10 | 14950889 | + | TCAACACACATAACAGAACAAGG | 1 | 4 | 82 | SEQ ID NO. 580 |
| (N20)NGG | 10 | 14950898 | + | ATAACAGAACAAGGAAGTCAAGG | 1 | 10 | 104 | SEQ ID NO. 581 |
| (N20)NGG | 10 | 14950902 | + | CAGAACAAGGAAGTCAAGGCTGG | 1 | 6 | 74 | SEQ ID NO. 582 |
| (N20)NGG | 10 | 14950903 | + | AGAACAAGGAAGTCAAGGCTGGG | 1 | 14 | 244 | SEQ ID NO. 583 |
| (N20)NGG | 10 | 14950952 | + | TCTTCCAAGAGAGAAACAGTGG | 1 | 7 | 125 | SEQ ID NO. 584 |
| (N20)NGG | 10 | 14950953 | + | CTTTCCAAGAGAGAAACAGTGGG | 1 | 5 | 98 | SEQ ID NO. 585 |
| (N20)NGG | 10 | 14950954 | + | TTCCCAAGAGAGAAACAGTGGGG | 1 | 6 | 70 | SEQ ID NO. 586 |
| (N20)NGG | 10 | 14950969 | + | CAGTGGGGATATTCCTCTCCTTGG | 1 | 1 | 30 | SEQ ID NO. 587 |
| (N20)NGG | 10 | 14951023 | + | GAATATTCCTGCCTCTCATGG | 1 | 4 | 39 | SEQ ID NO. 588 |
| (N20)NGG | 10 | 14951047 | + | ACAAAATGTAATTTGCCCAAAGG | 2 | 12 | 88 | SEQ ID NO. 589 |

FIG. 4

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | SEQ ID NO. |
|---|---|---|---|---|---|---|---|---|
| (N20)NGG | 10 | 14951105 | + | GTGACAATAGTTCCTAGTACTGG | | 1 | 19 | SEQ ID NO. 590 |
| (N20)NGG | 10 | 14951146 | + | CAGTGAGACACATATACCCGAGG | | 2 | 8 | SEQ ID NO. 591 |
| (N20)NGG | 10 | 14951272 | + | ACAATATTTATATGAGAAGCTGG | | 5 | 70 | SEQ ID NO. 592 |
| (N20)NGG | 10 | 14951279 | + | TTATATGAGAAGCTGGCAACTGG | | 3 | 39 | SEQ ID NO. 593 |
| (N20)NGG | 10 | 14950385 | - | CTCTGTGGGACAAACAAAACAGG | | 5 | 76 | SEQ ID NO. 594 |
| (N20)NGG | 10 | 14950399 | - | TAGTCATCTTCCTCCTCTGTGGG | | 6 | 82 | SEQ ID NO. 595 |
| (N20)NGG | 10 | 14950400 | - | ATAGTCATCTTCCTCCTCTGTGG | | 5 | 77 | SEQ ID NO. 596 |
| (N20)NGG | 10 | 14950435 | - | TGCCCTAAAGGTATTGGCAGAGG | | 3 | 28 | SEQ ID NO. 597 |
| (N20)NGG | 10 | 14950441 | - | ACTTTGTGCCTTAAAGGTATTGG | | 2 | 37 | SEQ ID NO. 598 |
| (N20)NGG | 10 | 14950447 | - | TATGGAACTTTGTGCCTTAAAGG | | 3 | 49 | SEQ ID NO. 599 |
| (N20)NGG | 10 | 14950465 | - | GGGTGAAAAGTTTCCGGGTATGG | 1 | 1 | 17 | SEQ ID NO. 600 |
| (N20)NGG | 10 | 14950470 | - | CCTCAGGGTGAAAAGTTTCCGGG | | 6 | 69 | SEQ ID NO. 601 |
| (N20)NGG | 10 | 14950471 | - | ACCTCAGGGTGAAAAGTTTCCGG | 4 | 6 | 46 | SEQ ID NO. 602 |
| (N20)NGG | 10 | 14950485 | - | CAGTCATTGAAAATACCTCAGGG | | 2 | 52 | SEQ ID NO. 603 |
| (N20)NGG | 10 | 14950486 | - | GCAGTCATTGAAAATACCTCAGG | | 2 | 29 | SEQ ID NO. 604 |
| (N20)NGG | 10 | 14950525 | - | GGGGTTTGTCTCAGTTTTTCAGG | 1 | 4 | 48 | SEQ ID NO. 605 |
| (N20)NGG | 10 | 14950544 | - | CTCTGCTCTGCAGCATCCTGGGG | 2 | 17 | 132 | SEQ ID NO. 606 |
| (N20)NGG | 10 | 14950545 | - | ACTCTGCTCTGCAGCATCCTGGG | 3 | 10 | 93 | SEQ ID NO. 607 |
| (N20)NGG | 10 | 14950546 | - | CACTCTGCTCTGCAGCATCCTGG | 1 | 9 | 79 | SEQ ID NO. 608 |
| (N20)NGG | 10 | 14950613 | - | TTCTTCTTCACTTTCACTGTTGG | 1 | 10 | 150 | SEQ ID NO. 609 |
| (N20)NGG | 10 | 14950644 | - | GATCTCCTTGCAGTGAAGCTGGG | 1 | 2 | 33 | SEQ ID NO. 610 |
| (N20)NGG | 10 | 14950645 | - | AGATCTCCTTGCAGTGAAGCTGG | 1 | 4 | 45 | SEQ ID NO. 611 |
| (N20)NGG | 10 | 14950683 | - | CATCCCCATCAGCCTTTTGCAGG | 1 | 6 | 57 | SEQ ID NO. 612 |
| (N20)NGG | 10 | 14950708 | - | TTAAAGAATACTTCCCACTGGGG | 1 | 6 | 67 | SEQ ID NO. 613 |
| (N20)NGG | 10 | 14950709 | - | TTTAAAGAATACTTCCCACTGGG | 1 | 4 | 89 | SEQ ID NO. 614 |
| (N20)NGG | 10 | 14950710 | - | TTTTAAAGAATACTTCCCACTGG | 2 | 9 | 108 | SEQ ID NO. 615 |
| (N20)NGG | 10 | 14950770 | - | CCCCTGCCACTGTGGAGGAAGGG | 1 | 5 | 68 | SEQ ID NO. 616 |
| (N20)NGG | 10 | 14950771 | - | CCCCCTGCCACTGTGGAGGAAGG | 1 | 4 | 70 | SEQ ID NO. 617 |
| (N20)NGG | 10 | 14950775 | - | AGATCCCCCTGCCACTGTGGAGG | 1 | 3 | 43 | SEQ ID NO. 618 |
| (N20)NGG | 10 | 14950778 | - | CTGAGATCCCCCTGCCACTGTGG | 1 | 3 | 67 | SEQ ID NO. 619 |
| (N20)NGG | 10 | 14950804 | - | TCAGAGTCACTGAAAAGCTTTGG | 1 | 6 | 66 | SEQ ID NO. 620 |
| (N20)NGG | 10 | 14950847 | - | TGACTGGGAAGAATTCTGGGAGG | 1 | 4 | 86 | SEQ ID NO. 621 |
| (N20)NGG | 10 | 14950850 | - | TGTTGACTGGGAAGAATTCTGGG | 1 | 6 | 74 | SEQ ID NO. 622 |

FIG. 4 cont.

| site type | site chromosome | site_start_nucleotide | site strand | target_site_sequence_with NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 10 | 14950851 | - | GTGTTGACTGGAAGAATTCTGG | 1 | 4 | 57 | SEQ ID NO. 623 |
| (N20)NGG | 10 | 14950862 | - | TTCTGTTATGTGTTGACTGGG | 1 | 7 | 48 | SEQ ID NO. 624 |
| (N20)NGG | 10 | 14950863 | - | GTTCTGTTATGTGTTGACTGG | 1 | 2 | 37 | SEQ ID NO. 625 |
| (N20)NGG | 10 | 14950908 | - | ATAACAAAACAGTATCAGATTGG | 1 | 7 | 120 | SEQ ID NO. 626 |
| (N20)NGG | 10 | 14950934 | - | ATCCCCACTGTTTCTCTCTTGG | 1 | 4 | 83 | SEQ ID NO. 627 |
| (N20)NGG | 10 | 14950935 | - | TATCCCCACTGTTTCTCTCTTGG | 1 | 4 | 66 | SEQ ID NO. 628 |
| (N20)NGG | 10 | 14950964 | - | TCTGTAGTCAGCTTTGTCAAGG | 1 | 2 | 46 | SEQ ID NO. 629 |
| (N20)NGG | 10 | 14950987 | - | GGAATATTCTCTTTGATTGTTGG | 1 | 1 | 64 | SEQ ID NO. 630 |
| (N20)NGG | 10 | 14951008 | - | TTTTGTTCCATGAGAGAGGCAGG | 1 | 3 | 41 | SEQ ID NO. 631 |
| (N20)NGG | 10 | 14951012 | - | TACATTTGTTCCATGAGAGAGG | 1 | 3 | 70 | SEQ ID NO. 632 |
| (N20)NGG | 10 | 14951040 | - | AATCAGAGTAAGTATCCTTTGGG | 1 | 5 | 70 | SEQ ID NO. 633 |
| (N20)NGG | 10 | 14951041 | - | AAATCAGAGTAAGTATCCTTTGG | 1 | 4 | 59 | SEQ ID NO. 634 |
| (N20)NGG | 10 | 14951095 | - | GTAGTTGGTTCTCCAGTACTAGG | 1 | 2 | 33 | SEQ ID NO. 635 |
| (N20)NGG | 10 | 14951110 | - | GTCCTCACTGCTTAGAGTAGTTGG | 1 | 1 | 19 | SEQ ID NO. 636 |
| (N20)NGG | 10 | 14951140 | - | TTTAGCAAACTTTTTCCTCGG | 1 | 10 | 106 | SEQ ID NO. 637 |
| (N20)NGG | 10 | 14951141 | - | ATTTAGCAAACTTTTTTCCTCGG | 2 | 9 | 151 | SEQ ID NO. 638 |
| (N20)NGG | 10 | 14951183 | - | TTCAAAATCAGAAGAGCTCTGGG | 1 | 4 | 77 | SEQ ID NO. 639 |
| (N20)NGG | 10 | 14951184 | - | CTTCAAAATCAGAAGAGCTCTGG | 1 | 3 | 62 | SEQ ID NO. 640 |
| (N20)NGG | 10 | 14951209 | - | AACTCAGCTTCTGGAGTTGAGGG | 1 | 9 | 165 | SEQ ID NO. 641 |
| (N20)NGG | 10 | 14951210 | - | TAACTCAGCTTCTGGAGTTGAGG | 1 | 3 | 77 | SEQ ID NO. 642 |
| (N20)NGG | 10 | 14951218 | - | CGTTTAGGTAACTCAGCTTCGG | 1 | 2 | 12 | SEQ ID NO. 643 |
| (N20)NGG | 10 | 14951233 | - | TATTGTAAATGCTCTCGTTTAGG | 1 | 3 | 37 | SEQ ID NO. 644 |
| (N20)NGG | 10 | 14951324 | - | TTGAAACGCTTTGAATTCTTAGG | 2 | 6 | 54 | SEQ ID NO. 645 |
| (N20)NGG | 10 | 14961754 | + | TCAGCTTAAAGCTTTATGCCGG | 1 | 4 | 22 | SEQ ID NO. 646 |
| (N20)NGG | 10 | 14961770 | + | ATGCCGGTCTTCCAAAGTACGG | 1 | 2 | 11 | SEQ ID NO. 647 |
| (N20)NGG | 10 | 14961791 | + | GGAGCCAAAGTATAAACCACTGG | 1 | 2 | 33 | SEQ ID NO. 648 |
| (N20)NGG | 10 | 14961792 | + | GAGCCAAAGTATAAACCACTGGG | 1 | 3 | 43 | SEQ ID NO. 649 |
| (N20)NGG | 10 | 14961831 | + | AGAACAGTTCACCGAGACTCAGG | 1 | 1 | 17 | SEQ ID NO. 650 |
| (N20)NGG | 10 | 14961843 | + | CGAGACTCAGGTAAGAAAAATGG | 1 | 3 | 71 | SEQ ID NO. 651 |
| (N20)NGG | 10 | 14961849 | + | TCAGTAAGAAAAATGGTCCTGG | 1 | 3 | 48 | SEQ ID NO. 652 |
| (N20)NGG | 10 | 14961850 | + | CAGGTAAGAAAAATGGTCCTGGG | 1 | 7 | 69 | SEQ ID NO. 653 |
| (N20)NGG | 10 | 14961743 | - | CTTTGGGAAGACCGGCATAAAGG | 1 | 2 | 8 | SEQ ID NO. 654 |
| (N20)NGG | 10 | 14961751 | - | GCTCCGTACTTTGGGAAGACCGG | 1 | 4 | 91 | SEQ ID NO. 655 |

FIG. 4 cont.

| site type | site chr omosome | site start nucleotide | site s trand | target_site_sequence_wi th NGG | genome_wide_ hits_with_1 or_less_mism atches | genome_wide_ hits_with_2 or_less_mism atches | genome_wide_ hits_with_3 or_less_mism atches | | |
|---|---|---|---|---|---|---|---|---|---|
| (N20)NGG | 10 | 14961759 | - | ATACTTTGGCTCCGTACTTTGGG | 1 | 3 | 20 | SEQ ID NO. | 656 |
| (N20)NGG | 10 | 14961760 | - | TATACTTTGGCTCCGTACTTTGG | 1 | 1 | 8 | SEQ ID NO. | 657 |
| (N20)NGG | 10 | 14961773 | - | TTTCCCAGTGGTTTATACTTTGG | 1 | 4 | 78 | SEQ ID NO. | 658 |
| (N20)NGG | 10 | 14961785 | - | GCTCTCTTCAGTTTTCCCAGTGG | 1 | 9 | 90 | SEQ ID NO. | 659 |
| (N20)NGG | 10 | 14961820 | - | CATTTTTCTTACCTGAGTCTCGG | 2 | 10 | 114 | SEQ ID NO. | 660 |
| (N20)NGG | 10 | 14965040 | + | TATCCAAATGTCATTCCAGTTGG | 1 | 3 | 53 | SEQ ID NO. | 661 |
| (N20)NGG | 10 | 14965051 | + | CATTCCAGTTGGCACAACTATGG | 1 | 2 | 25 | SEQ ID NO. | 662 |
| (N20)NGG | 10 | 14965082 | + | GTCGAAATGTGAGTAGTCACTGG | 1 | 1 | 9 | SEQ ID NO. | 663 |
| (N20)NGG | 10 | 14965088 | + | ATGTGAGTAGTCACTGGTTGTGG | 1 | 4 | 27 | SEQ ID NO. | 664 |
| (N20)NGG | 10 | 14965089 | + | TGTGAGTAGTCACTGGTTGTGGG | 2 | 2 | 28 | SEQ ID NO. | 665 |
| (N20)NGG | 10 | 14964956 | - | CTAGAAAAAGGAAAATCACATGG | 3 | 15 | 312 | SEQ ID NO. | 666 |
| (N20)NGG | 10 | 14964968 | - | GAAATCTTTAATCTAGAAAAAGG | 2 | 19 | 176 | SEQ ID NO. | 667 |
| (N20)NGG | 10 | 14964999 | - | GATATGCGTTCACAGGACAGAGG | 1 | 2 | 12 | SEQ ID NO. | 668 |
| (N20)NGG | 10 | 14965006 | - | ACATTTGGATATGCGTTCACAGG | 1 | 1 | 13 | SEQ ID NO. | 669 |
| (N20)NGG | 10 | 14965021 | - | GTGCCAACTGGAATGACATTTGG | 1 | 1 | 33 | SEQ ID NO. | 670 |
| (N20)NGG | 10 | 14965033 | - | TTATCCATAGTTGTGCCAACTGG | 1 | 2 | 22 | SEQ ID NO. | 671 |
| (N20)NGG | 10 | 14968841 | + | TTGTGTTTTCACTTCCCTTTAGG | 2 | 12 | 229 | SEQ ID NO. | 672 |
| (N20)NGG | 10 | 14968846 | + | TTTTTCACTTCCCTTTAGGACTGG | 1 | 2 | 54 | SEQ ID NO. | 673 |
| (N20)NGG | 10 | 14968896 | + | TTTTCACTCCTCCTACAGTCAGG | 1 | 1 | 51 | SEQ ID NO. | 674 |
| (N20)NGG | 10 | 14968903 | + | TCCTCCTACAGTGAGGTAAGAGG | 2 | 2 | 27 | SEQ ID NO. | 675 |
| (N20)NGG | 10 | 14968833 | - | GAACTCTCTCCAGTCCTAAAGGG | 1 | 4 | 27 | SEQ ID NO. | 676 |
| (N20)NGG | 10 | 14968834 | - | TGAACTCTCTCCAGTCCTAAAGG | 1 | 1 | 28 | SEQ ID NO. | 677 |
| (N20)NGG | 10 | 14968882 | - | TCCTCTTACCTCACTGTAGGAGG | 2 | 2 | 44 | SEQ ID NO. | 678 |
| (N20)NGG | 10 | 14968885 | - | GGATCCTCTTACCTCACTGTAGG | 1 | 5 | 33 | SEQ ID NO. | 679 |
| (N20)NGG | 10 | 14970014 | + | CTATGCTTTTTATCTTTTTTAGG | 1 | 55 | 838 | SEQ ID NO. | 680 |
| (N20)NGG | 10 | 14970020 | + | TTTTTATCTTTTTTAGGCAGAGG | 2 | 43 | 1301 | SEQ ID NO. | 681 |
| (N20)NGG | 10 | 14970034 | + | AGGCAGAGAGGAATATTTTCAGTGG | 2 | 9 | 115 | SEQ ID NO. | 682 |
| (N20)NGG | 10 | 14970051 | + | CAGTGGAGCAAATTACCCTGTGG | 1 | 3 | 35 | SEQ ID NO. | 683 |
| (N20)NGG | 10 | 14970112 | + | GCATTAAGCATCCACCATGTGG | 1 | 2 | 21 | SEQ ID NO. | 684 |
| (N20)NGG | 10 | 14970117 | + | AAGCCATCCACCATGTGGTTTGG | 1 | 4 | 38 | SEQ ID NO. | 685 |
| (N20)NGG | 10 | 14970124 | + | CCACCATGTGGTTTGGAGAAAGG | 1 | 7 | 49 | SEQ ID NO. | 686 |
| (N20)NGG | 10 | 14970151 | + | GAAAAACAAATGTAATTGTGAGG | 2 | 11 | 216 | SEQ ID NO. | 687 |
| (N20)NGG | 10 | 14970171 | + | AGGTAAGAGAGCAATATCATAGG | 1 | 1 | 33 | SEQ ID NO. | 688 |

FIG. 4 cont.

| site type | site chr omosome | site start nucleotide | site s trand | target site sequence with NGG | genome wide hits with 1 or less mism atches | genome wide hits with 2 or less mism atches | genome wide hits with 3 or less mism atches | |
|---|---|---|---|---|---|---|---|---|
| (N20)NGG | 10 | 14970044 | - | TTTCTGGAAGTAATTCCACAGGG | 2 | 8 | 107 | SEQ ID NO. 689 |
| (N20)NGG | 10 | 14970045 | - | ATTTCTGGAAGTAATTCCACAGG | 2 | 5 | 67 | SEQ ID NO. 690 |
| (N20)NGG | 10 | 14970060 | - | GTGGAGTGGAATTCTATTTCTGG | 1 | 1 | 38 | SEQ ID NO. 691 |
| (N20)NGG | 10 | 14970074 | - | TTAATGCTGATTATGTGGAGTGG | 1 | 1 | 60 | SEQ ID NO. 692 |
| (N20)NGG | 10 | 14970079 | - | ATGGCTTAATGCTGATTATGTGG | 1 | 8 | 65 | SEQ ID NO. 693 |
| (N20)NGG | 10 | 14970098 | - | TCTCCAAACCACATGGTGGATGG | 1 | 4 | 51 | SEQ ID NO. 694 |
| (N20)NGG | 10 | 14970102 | - | CCTTTCTCCAAACCACATGGTGG | 1 | 9 | 53 | SEQ ID NO. 695 |
| (N20)NGG | 10 | 14970105 | - | GCTCCTTTCTCCAAACCACATGG | 2 | 10 | 84 | SEQ ID NO. 696 |
| (N20)NGG | 10 | 14974852 | + | ATGTATGTATTATTTGCCTTAGG | 1 | 7 | 147 | SEQ ID NO. 697 |
| (N20)NGG | 10 | 14974881 | + | TGAATAAGCTAGACATGTTTAGG | 2 | 4 | 58 | SEQ ID NO. 698 |
| (N20)NGG | 10 | 14974944 | + | ACACTCAGATCCATGCATGCCGG | 2 | 5 | 43 | SEQ ID NO. 699 |
| (N20)NGG | 10 | 14974954 | + | CCATGCATGCCGGCATCCCAAGG | 1 | 2 | 34 | SEQ ID NO. 700 |
| (N20)NGG | 10 | 14974846 | - | AGCTTATTCACATGAACCTAAGG | 1 | 5 | 45 | SEQ ID NO. 701 |
| (N20)NGG | 10 | 14974888 | - | GTGAGATGATGAAGGATCTCAGG | 2 | 4 | 58 | SEQ ID NO. 702 |
| (N20)NGG | 10 | 14974896 | - | GGTCTGTTGTGAGATGATGAAGG | 2 | 6 | 47 | SEQ ID NO. 703 |
| (N20)NGG | 10 | 14974917 | - | ATGCATGGATCTGAGTGTTGCGG | 2 | 6 | 47 | SEQ ID NO. 704 |
| (N20)NGG | 10 | 14974932 | - | CCTTGGGATGCCGGCATGCCGG | 1 | 1 | 23 | SEQ ID NO. 705 |
| (N20)NGG | 10 | 14974941 | - | GCACACGTACCTTGGGATGCCGG | 1 | 1 | 7 | SEQ ID NO. 706 |
| (N20)NGG | 10 | 14974948 | - | ATCACTTGCACACGTACCTTGGG | 1 | 1 | 10 | SEQ ID NO. 707 |
| (N20)NGG | 10 | 14974949 | - | AATCACTTGCACACGTACCTTGG | 2 | 1 | 22 | SEQ ID NO. 708 |
| (N20)NGG | 10 | 14976378 | + | GTCTCTTTAAAATCCTGTCTAGG | 2 | 6 | 86 | SEQ ID NO. 709 |
| (N20)NGG | 10 | 14976381 | + | TCTTTAAAATCCTGTCTAGGAGG | 2 | 6 | 64 | SEQ ID NO. 710 |
| (N20)NGG | 10 | 14976394 | + | GTCTAGGAGGAGTGTTTAAGTGG | 2 | 2 | 30 | SEQ ID NO. 711 |
| (N20)NGG | 10 | 14976408 | + | TTTAAGTGGAGTCTTAGAGCTGG | 2 | 2 | 35 | SEQ ID NO. 712 |
| (N20)NGG | 10 | 14976419 | + | TCTTAGAGCTGGTCCGAAGCTGG | 1 | 3 | 9 | SEQ ID NO. 713 |
| (N20)NGG | 10 | 14976428 | + | TGGTCCGAAGCTGGATCACTCGG | 1 | 2 | 8 | SEQ ID NO. 714 |
| (N20)NGG | 10 | 14976449 | + | GGAGCCCGTACCATGTTGTGTGG | 1 | 2 | 13 | SEQ ID NO. 715 |
| (N20)NGG | 10 | 14976465 | + | TGTGTGGCTGAACTGCAAAGCGG | 2 | 5 | 52 | SEQ ID NO. 716 |
| (N20)NGG | 10 | 14976472 | + | CTGAACTGCAAAGCGGCTTATGG | 3 | 3 | 31 | SEQ ID NO. 717 |
| (N20)NGG | 10 | 14976511 | + | ACCAACCTTAGTGAAGAATTAGG | 3 | 4 | 32 | SEQ ID NO. 718 |
| (N20)NGG | 10 | 14976519 | + | TAGTGAAGAATTAGGAGTCCAGG | 2 | 5 | 35 | SEQ ID NO. 719 |
| (N20)NGG | 10 | 14976524 | + | AAGAATTAGGAGTCCAGGTATGG | 2 | 6 | 86 | SEQ ID NO. 720 |
| (N20)NGG | 10 | 14976369 | - | CTTAAACACTCCTCCTAGACAGG | 2 | 4 | 25 | SEQ ID NO. 721 |

FIG. 4 cont.

| site_type | site_chr omosome | site_start_ nucleotide | site_s trand | target_site_sequence_wi th_NGG | genome_wide_ hits_with_1 or_less_mism atches | genome_wide_ hits_with_2 or_less_mism atches | genome_wide_ hits_with_3 or_less_mism atches | | |
|---|---|---|---|---|---|---|---|---|---|
| (N20)NGG | 10 | 14976410 | - | GGCTCCAGTGATCCAGCTTCGG | 1 | 3 | 22 | SEQ ID NO. | 722 |
| (N20)NGG | 10 | 14976431 | - | TCAGCCACACAACATGGTACGGG | 2 | 8 | 158 | SEQ ID NO. | 723 |
| (N20)NGG | 10 | 14976432 | - | TTCAGCCACACAACATGGTACGG | 2 | 4 | 30 | SEQ ID NO. | 724 |
| (N20)NGG | 10 | 14976437 | - | TGCAGTTCAGCCACACAACATGG | 2 | 3 | 60 | SEQ ID NO. | 725 |
| (N20)NGG | 10 | 14976490 | - | TCCTAATTCTTCACTAAGGTTGG | 2 | 6 | 37 | SEQ ID NO. | 726 |
| (N20)NGG | 10 | 14976494 | - | GGACTCCTAATTCTTCACTAAGG | 2 | 2 | 18 | SEQ ID NO. | 727 |
| (N20)NGG | 10 | 14976515 | - | GAATGAACAGTCACCATACCTGG | 2 | 6 | 26 | SEQ ID NO. | 728 |
| (N20)NGG | 10 | 14976729 | + | AGACATCCAAAGTGTATATTTGG | 2 | 6 | 50 | SEQ ID NO. | 729 |
| (N20)NGG | 10 | 14976773 | + | GATTTTACCAAATTCCAAGTCGG | 4 | 8 | 74 | SEQ ID NO. | 730 |
| (N20)NGG | 10 | 14976774 | + | ATTTTACCAAATTCCAAGTCGGG | 2 | 5 | 52 | SEQ ID NO. | 731 |
| (N20)NGG | 10 | 14976787 | + | CCAAGTCGGGTAAGTCTGCCTGG | 2 | 2 | 14 | SEQ ID NO. | 732 |
| (N20)NGG | 10 | 14976790 | + | AGTCGGGTAAGTCTGCCTGGAGG | 2 | 4 | 29 | SEQ ID NO. | 733 |
| (N20)NGG | 10 | 14976796 | + | GTAAGTCTGCCTGGAGGAACAGG | 2 | 5 | 41 | SEQ ID NO. | 734 |
| (N20)NGG | 10 | 14976797 | + | TAAGTCTGCCTGGAGGAACAGGG | 2 | 3 | 53 | SEQ ID NO. | 735 |
| (N20)NGG | 10 | 14976713 | + | TAGTATCCAAATATACACTTTGG | 2 | 8 | 49 | SEQ ID NO. | 736 |
| (N20)NGG | 10 | 14976747 | - | CTTGGAATTTGGTAAAATCTTGG | 3 | 13 | 87 | SEQ ID NO. | 737 |
| (N20)NGG | 10 | 14976758 | - | GACTTACCCGACTTGGAATTTGG | 2 | 2 | 15 | SEQ ID NO. | 738 |
| (N20)NGG | 10 | 14976765 | - | CCAGGCAGACTTACCCGACTTGG | 2 | 2 | 16 | SEQ ID NO. | 739 |
| (N20)NGG | 10 | 14977461 | + | CTGGGATATATTTCTTTTTTCAGG | 2 | 7 | 140 | SEQ ID NO. | 740 |
| (N20)NGG | 10 | 14977474 | + | CTTTTTCAGGTTTTTATTTCAGG | 3 | 21 | 378 | SEQ ID NO. | 741 |
| (N20)NGG | 10 | 14977475 | + | TTTTTTCAGGTTTTTATTTCAGGG | 5 | 53 | 552 | SEQ ID NO. | 742 |
| (N20)NGG | 10 | 14977484 | + | TTTTTATTTCAGGCAATAATGG | 2 | 11 | 217 | SEQ ID NO. | 743 |
| (N20)NGG | 10 | 14977502 | + | AATGGAACTGTCCTGTACACAGG | 1 | 6 | 36 | SEQ ID NO. | 744 |
| (N20)NGG | 10 | 14977516 | + | GTACACAGGAGACTTCAGATTGG | 2 | 3 | 44 | SEQ ID NO. | 745 |
| (N20)NGG | 10 | 14977523 | + | GGAGACTTCAGATTGGCGCAAGG | 1 | 3 | 15 | SEQ ID NO. | 746 |
| (N20)NGG | 10 | 14977540 | + | GCAAGGAGAAGCTGCTAGAATGG | 3 | 7 | 73 | SEQ ID NO. | 747 |
| (N20)NGG | 10 | 14977556 | + | AGAATGGAGCTTCTGCACTCCGG | 2 | 5 | 95 | SEQ ID NO. | 748 |
| (N20)NGG | 10 | 14977557 | + | GAATGGAGCTTCTGCACTCCGGG | 2 | 2 | 36 | SEQ ID NO. | 749 |
| (N20)NGG | 10 | 14977558 | + | AATGGAGCTTCTGCACTCCGGGG | 2 | 2 | 17 | SEQ ID NO. | 750 |
| (N20)NGG | 10 | 14977559 | + | ATGGAGCTTCTGCACTCCGGGGG | 2 | 3 | 20 | SEQ ID NO. | 751 |
| (N20)NGG | 10 | 14977563 | + | AGCTTCTGCACTCCGGGGGCAGG | 2 | 4 | 36 | SEQ ID NO. | 752 |
| (N20)NGG | 10 | 14977569 | + | TGCACTCCGGGGGCAGGTACTGG | 2 | 5 | 19 | SEQ ID NO. | 753 |
| (N20)NGG | 10 | 14977570 | + | GCACTCCGGGGGCAGGTACTGGG | 2 | 2 | 11 | SEQ ID NO. | 754 |

FIG. 4 cont.

| site_type | site_chr omosome | site_start_ nucleotide | site_s trand | target_site_sequence with NGG | genome_wide_ hits_with_1_ or_less_mism atches | genome_wide_ hits_with_2_ or_less_mism atches | genome_wide_ hits_with_3_ or_less_mism atches | |
|---|---|---|---|---|---|---|---|---|
| (N20)NGG | 10 | 14977581 | + | GCAGGTACTGGGCCTCGTATAGG | | 2 | 3 | 14 SEQ ID NO. 755 |
| (N20)NGG | 10 | 14977491 | - | ATCTGAAGTCTCCTGTGTACAGG | | 2 | 4 | 39 SEQ ID NO. 756 |
| (N20)NGG | 10 | 14977553 | - | CGAGGCCCAGTACCTGCCCCCGG | | 2 | 4 | 57 SEQ ID NO. 757 |
| (N20)NGG | 10 | 14978539 | + | TTCTTTATTTTCTTTTTAGAAGG | | 15 | 1012 | 20720 SEQ ID NO. 758 |
| (N20)NGG | 10 | 14978570 | + | GTTGTGACTCTCTTACCAGCTGG | | 1 | 2 | 25 SEQ ID NO. 759 |
| (N20)NGG | 10 | 14978581 | + | CTTACCAGCTGGTCACTGTCCGG | | 1 | 2 | 23 SEQ ID NO. 760 |
| (N20)NGG | 10 | 14978582 | + | TTACCAGCTGGTCACTGTCCGGG | | 1 | 3 | 29 SEQ ID NO. 761 |
| (N20)NGG | 10 | 14978597 | + | TGTCCGGGATCAGTTATGTAAGG | | 1 | 1 | 4 SEQ ID NO. 762 |
| (N20)NGG | 10 | 14978598 | + | GTCCGGGATCAGTTATGTAAGGG | | 1 | 1 | 6 SEQ ID NO. 763 |
| (N20)NGG | 10 | 14978599 | + | CCGGGATCAGTTATGTAAGGGG | | 1 | 1 | 9 SEQ ID NO. 764 |
| (N20)NGG | 10 | 14978600 | + | CCGGGATCAGTTATGTAAGGGGG | | 1 | 1 | 7 SEQ ID NO. 765 |
| (N20)NGG | 10 | 14978563 | - | GATCCCGGACAGTGACCAGCTGG | | 1 | 1 | 11 SEQ ID NO. 766 |
| (N20)NGG | 10 | 14978578 | - | CCCCCTTACATAACTGATCCCGG | | 1 | 1 | 5 SEQ ID NO. 767 |
| (N20)NGG | 10 | 14981850 | + | TCCTACCCAGATATCTTTAGTGG | | 2 | 4 | 28 SEQ ID NO. 768 |
| (N20)NGG | 10 | 14981863 | + | TCTTTAGTGGATGAAGCATCAGG | | 2 | 2 | 30 SEQ ID NO. 769 |
| (N20)NGG | 10 | 14981868 | + | AGTGGATGAAGCATCAGGAGAGG | | 2 | 7 | 68 SEQ ID NO. 770 |
| (N20)NGG | 10 | 14981829 | - | TCCACTAAAGATATCTGGGTAGG | | 2 | 4 | 31 SEQ ID NO. 771 |
| (N20)NGG | 10 | 14981833 | - | TTCATCCACTAAAGATATCTGGG | | 2 | 4 | 48 SEQ ID NO. 772 |
| (N20)NGG | 10 | 14981834 | - | CTTCATCCACTAAAGATATCTGG | | 2 | 2 | 29 SEQ ID NO. 773 |
| (N20)NGG | 10 | 14987110 | + | CTTTTTTTCCTTTCAGCTGAAGG | | 1 | 8 | 175 SEQ ID NO. 774 |
| (N20)NGG | 10 | 14987140 | + | ATACTGTTCACCTGTGACTAAGG | | 1 | 1 | 23 SEQ ID NO. 775 |
| (N20)NGG | 10 | 14987175 | + | CGAGCCCGAAATACAGATTTTGG | | 1 | 1 | 14 SEQ ID NO. 776 |
| (N20)NGG | 10 | 14987095 | - | AGATAAACCTTCAAGCTGAAAGG | | 1 | 5 | 44 SEQ ID NO. 777 |
| (N20)NGG | 10 | 14987128 | - | AACAACAACTCCTTAGTCACAGG | | 1 | 1 | 17 SEQ ID NO. 778 |
| (N20)NGG | 10 | 14987157 | - | TCTTCCAAAATCTGTATTTCGGG | | 1 | 16 | 173 SEQ ID NO. 779 |
| (N20)NGG | 10 | 14987158 | - | TTCTTCCAAAATCTGTATTTCGG | | 4 | 19 | 226 SEQ ID NO. 780 |
| (N20)NGG | 10 | 14991046 | + | TTGTTTTTAGATCACATGAAAGG | | 1 | 6 | 109 SEQ ID NO. 781 |
| (N20)NGG | 10 | 14991074 | + | GAGCCCTACCTTGAAAAGAAGG | | 1 | 6 | 40 SEQ ID NO. 782 |
| (N20)NGG | 10 | 14991078 | + | CCCTACCTTGAAAAGAAGGTTGG | | 1 | 2 | 29 SEQ ID NO. 783 |
| (N20)NGG | 10 | 14991086 | + | TGAAAAGAAGGTTGGAGTGCAGG | | 1 | 3 | 60 SEQ ID NO. 784 |
| (N20)NGG | 10 | 14991055 | - | CAACCTTCTTTTCAAGGTAGGGG | | 1 | 2 | 64 SEQ ID NO. 785 |
| (N20)NGG | 10 | 14991056 | - | CCAACCTTCTTTTCAAGGTAGG | | 1 | 3 | 43 SEQ ID NO. 786 |
| (N20)NGG | 10 | 14991057 | - | TCCAACCTTCTTTTCAAGGTAGG | | 2 | 6 | 53 SEQ ID NO. 787 |

FIG. 4 cont.

| site_type | site_chr omosome | site_start_ nucleotide | site_s trand | target_site_sequence_wi th_NGG | genome_wide_ hits_with_1_ or_less_mism atches | genome_wide_ hits_with_2_ or_less_mism atches | genome_wide_ hits_with_3_ or_less_mism atches | |
|---|---|---|---|---|---|---|---|---|
| (N20)NGG | 10 | 14991061 | - | GCACTCCAACCTTCTTTTCAAGG | 2 | 2 | 45 | SEQ ID NO. 788 |
| (N20)NGG | 10 | 14995915 | + | CGGGCTATGAGTTCTTTCGAGG | 1 | 1 | 2 | SEQ ID NO. 789 |
| (N20)NGG | 10 | 14995916 | + | GGGCTATGAGTTCTTTCGAGGG | 1 | 1 | 4 | SEQ ID NO. 790 |
| (N20)NGG | 10 | 14995917 | + | GCGCTATGAGTTCTTTCGAGGGG | 1 | 1 | 8 | SEQ ID NO. 791 |
| (N20)NGG | 10 | 14995924 | + | GAGTTCTTTCGAGGGCAGATGG | 1 | 2 | 33 | SEQ ID NO. 792 |
| (N20)NGG | 10 | 14995962 | + | TCTCCATAGACCGCTTCGATAGG | 1 | 1 | 5 | SEQ ID NO. 793 |
| (N20)NGG | 10 | 14995963 | + | CTCCATAGACCGCTTCGATAGG | 1 | 1 | 1 | SEQ ID NO. 794 |
| (N20)NGG | 10 | 14995974 | + | GCTTCGATAGGGAGAACCTGAGG | 1 | 1 | 9 | SEQ ID NO. 795 |
| (N20)NGG | 10 | 14995975 | + | CTTCGATAGGGAGAACCTGAGG | 1 | 1 | 9 | SEQ ID NO. 796 |
| (N20)NGG | 10 | 14996009 | + | TTTCGTCCCACTGCCACAAAGG | 1 | 6 | 52 | SEQ ID NO. 797 |
| (N20)NGG | 10 | 14996018 | + | CACTGCCACAAAGGTGAGTGAGG | 1 | 4 | 42 | SEQ ID NO. 798 |
| (N20)NGG | 10 | 14996019 | + | ACTGCCACAAAGGTGAGTGAGG | 1 | 5 | 56 | SEQ ID NO. 799 |
| (N20)NGG | 10 | 14995875 | - | CGCCGCCGATCCCAGAGTCCGG | 1 | 1 | 13 | SEQ ID NO. 800 |
| (N20)NGG | 10 | 14995876 | - | GCGCCGCCGATCCCAGAGTCGG | 1 | 1 | 10 | SEQ ID NO. 801 |
| (N20)NGG | 10 | 14995925 | - | TATGGAGATAGTTGGATATCGG | 1 | 1 | 25 | SEQ ID NO. 802 |
| (N20)NGG | 10 | 14995933 | - | AAGCGGTCTATGGAGATAGTTGG | 1 | 1 | 10 | SEQ ID NO. 803 |
| (N20)NGG | 10 | 14995943 | - | CTCCCTATCGAAGCGGTCTATGG | 1 | 2 | 2 | SEQ ID NO. 804 |
| (N20)NGG | 10 | 14995950 | - | TCAGGTTCTCCCTATCGAAGCGG | 1 | 1 | 10 | SEQ ID NO. 805 |
| (N20)NGG | 10 | 14995968 | - | GGAAGTAGGCGCGGGCCCTCAGG | 1 | 2 | 18 | SEQ ID NO. 806 |
| (N20)NGG | 10 | 14995976 | - | GTGGGACAGGAAGTAGGCGCGG | 1 | 5 | 51 | SEQ ID NO. 807 |
| (N20)NGG | 10 | 14995977 | - | AGTGGGACAGGAAGTAGGCGCGG | 1 | 4 | 48 | SEQ ID NO. 808 |
| (N20)NGG | 10 | 14995982 | - | GTGGCAGTGGACAGGAAGTAGG | 1 | 5 | 123 | SEQ ID NO. 809 |
| (N20)NGG | 10 | 14995989 | - | CACCTTTGTGGCAGTGGACAGG | 1 | 4 | 35 | SEQ ID NO. 810 |
| (N20)NGG | 10 | 14995994 | - | TCACTCACCTTTGTGGCAGTGG | 1 | 4 | 43 | SEQ ID NO. 811 |
| (N20)NGG | 10 | 14995995 | - | CTCACTCACCTTTGTGGCAGTGG | 1 | 6 | 55 | SEQ ID NO. 812 |
| (N20)NGG | 10 | 14996001 | - | GCAGCCCTCACTCACCTTTGTGG | 1 | 6 | 73 | SEQ ID NO. 813 |

FIG. 4 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 5246833 | + | TATCTTCCTCCCACAGCTCCTGG | 1 | 6 | 114 | SEQ ID NO. 814 |
| (N20)NGG | 11 | 5246834 | + | ATCTTCCTCCCACAGCTCCTGGG | 2 | 14 | 155 | SEQ ID NO. 815 |
| (N20)NGG | 11 | 5246845 | + | ACAGCTCCTGGGCAACGTGCTGG | 1 | 6 | 44 | SEQ ID NO. 816 |
| (N20)NGG | 11 | 5246857 | + | CAACGTGCTGGTCTGTGTCTGG | 1 | 5 | 25 | SEQ ID NO. 817 |
| (N20)NGG | 11 | 5246870 | + | TGTGTGCTGGCCCATCACTTTGG | 1 | 2 | 47 | SEQ ID NO. 818 |
| (N20)NGG | 11 | 5246896 | + | AGAATTCACCCCACCAGTGCAGG | | 3 | 31 | SEQ ID NO. 819 |
| (N20)NGG | 11 | 5246914 | + | GCAGGCTGCCTATCAGAAAGTGG | 1 | 5 | 34 | SEQ ID NO. 820 |
| (N20)NGG | 11 | 5246917 | + | GGCTGCCTATCAGAAAGTGGTGG | 2 | 5 | 50 | SEQ ID NO. 821 |
| (N20)NGG | 11 | 5246921 | + | GCCTATCAGAAAGTGGTGCTGG | 2 | 7 | 86 | SEQ ID NO. 822 |
| (N20)NGG | 11 | 5246926 | + | TCAGAAAGTGGTGGCTGGTGTGG | 3 | 6 | 74 | SEQ ID NO. 823 |
| (N20)NGG | 11 | 5246938 | + | GGCTGGTGTGCTAATGCCCTGG | 2 | 5 | 34 | SEQ ID NO. 824 |
| (N20)NGG | 11 | 5246806 | - | AGCTGTGGGAGGAAGATAAGAGG | 1 | 9 | 146 | SEQ ID NO. 825 |
| (N20)NGG | 11 | 5246817 | - | CGTTGCCCAGGAGCTGTGGGAGG | 1 | 4 | 62 | SEQ ID NO. 826 |
| (N20)NGG | 11 | 5246820 | - | GCACGTTGCCCAGGAGCTGTGG | 1 | 3 | 39 | SEQ ID NO. 827 |
| (N20)NGG | 11 | 5246821 | - | AGCACGTTGCCCAGGAGCTGTGG | 1 | 3 | 57 | SEQ ID NO. 828 |
| (N20)NGG | 11 | 5246829 | - | CACAGACCAGCACGTTGCCCAGG | 1 | 3 | 26 | SEQ ID NO. 829 |
| (N20)NGG | 11 | 5246858 | - | GAATTCTTTGCCAAAGTGATGG | 1 | 6 | 77 | SEQ ID NO. 830 |
| (N20)NGG | 11 | 5246859 | - | TGAATTCTTTGCCAAAGTGATGG | 1 | 6 | 102 | SEQ ID NO. 831 |
| (N20)NGG | 11 | 5246882 | - | ATAGGCAGCCTGCACTGGTCGGG | 1 | 2 | 25 | SEQ ID NO. 832 |
| (N20)NGG | 11 | 5246883 | - | GATAGGCAGCCTGCACTGGTCGG | 1 | 2 | 30 | SEQ ID NO. 833 |
| (N20)NGG | 11 | 5246884 | - | TGATAGGCAGCCTGCACTGGTGG | 1 | 3 | 28 | SEQ ID NO. 834 |
| (N20)NGG | 11 | 5246887 | - | TTCTGATAGGCAGCCTGCACTGG | 1 | 3 | 35 | SEQ ID NO. 835 |
| (N20)NGG | 11 | 5246900 | - | ACCAGCACCACCACTTTCTGATAGG | 2 | 4 | 59 | SEQ ID NO. 836 |
| (N20)NGG | 11 | 5246993 | - | TTAGTGATACTTGTGGGCCAGG | 1 | 3 | 27 | SEQ ID NO. 837 |
| (N20)NGG | 11 | 5246934 | - | CTTAGTGATACTTGTGGGCCAGG | 1 | 1 | 22 | SEQ ID NO. 838 |
| (N20)NGG | 11 | 5246939 | - | GCGAGCTTAGTGATACTTGTGGG | 1 | 1 | 1 | SEQ ID NO. 839 |
| (N20)NGG | 11 | 5246940 | - | AGCGAGCTTAGTGATACTTGTGG | 1 | 1 | 8 | SEQ ID NO. 840 |
| (N20)NGG | 11 | 5247806 | + | TGGTCTATTTTCCACCCTTAGG | 2 | 6 | 54 | SEQ ID NO. 841 |
| (N20)NGG | 11 | 5247813 | + | TTTTCCCACCCTTAGGCTGCTGG | 1 | 2 | 40 | SEQ ID NO. 842 |
| (N20)NGG | 11 | 5247816 | + | TCCCACCCTTAGGCTGCTGGTGG | 1 | 7 | 50 | SEQ ID NO. 843 |
| (N20)NGG | 11 | 5247827 | + | GGCTGCTGGTCTACCCTTGG | 1 | 1 | 34 | SEQ ID NO. 844 |
| (N20)NGG | 11 | 5247836 | + | TGGTCTACCCTTGGACCCAGAGG | 2 | 6 | 27 | SEQ ID NO. 845 |
| (N20)NGG | 11 | 5247853 | + | CAGAGGTTCTTTGAGTCCTTTGG | 2 | 2 | 55 | SEQ ID NO. 846 |

FIG. 5

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 5247854 | + | AGAGGTTCTTTGAGTCCTTTGGG |  | 3 | 5 | 87 SEQ ID NO. 847 |
| (N20)NGG | 11 | 5247855 | + | GAGGTTCTTTGAGTCCTTTGGGG |  | 2 | 8 | 65 SEQ ID NO. 848 |
| (N20)NGG | 11 | 5247882 | + | GTCCACTCCTGATGCTGTTATGG |  | 2 | 6 | 50 SEQ ID NO. 849 |
| (N20)NGG | 11 | 5247883 | + | TCCACTCCTGATGCTGTTATGGG |  | 2 | 4 | 33 SEQ ID NO. 850 |
| (N20)NGG | 11 | 5247894 | + | TGCTGTTATGGCAACCCTAAGG |  | 2 | 4 | 23 SEQ ID NO. 851 |
| (N20)NGG | 11 | 5247900 | + | TATGGCAACCCTAAGGTGAAGG |  | 2 | 3 | 23 SEQ ID NO. 852 |
| (N20)NGG | 11 | 5247907 | + | AACCCTAAGGTGAAGGCTCATGG |  | 2 | 4 | 31 SEQ ID NO. 853 |
| (N20)NGG | 11 | 5247922 | + | GCTCATGGCAAGAAAGTGCTCGG |  | 2 | 6 | 45 SEQ ID NO. 854 |
| (N20)NGG | 11 | 5247937 | + | GTGCTCGGTGCCTTTAGTGATGG |  | 2 | 4 | 20 SEQ ID NO. 855 |
| (N20)NGG | 11 | 5247942 | + | CGGTGCCTTTAGTGATGGCCTGG |  | 2 | 3 | 23 SEQ ID NO. 856 |
| (N20)NGG | 11 | 5247951 | + | TAGTGATGGCCTGGCTCACCTGG |  | 2 | 5 | 29 SEQ ID NO. 857 |
| (N20)NGG | 11 | 5247963 | + | GGCTCACCTGGACAACCTCAAGG |  | 2 | 2 | 29 SEQ ID NO. 858 |
| (N20)NGG | 11 | 5247964 | + | GCTCACCTGGACAACCTCAAGGG |  | 2 | 3 | 40 SEQ ID NO. 859 |
| (N20)NGG | 11 | 5248011 | + | GCACTGTGACAAGCTGCACGTGG |  | 6 | 7 | 23 SEQ ID NO. 860 |
| (N20)NGG | 11 | 5248028 | + | ACGTGGATCCTGAGAACTTCAGG |  | 5 | 6 | 18 SEQ ID NO. 861 |
| (N20)NGG | 11 | 5248029 | + | CGTGGATCCTGAGAACTTCAGGG |  | 5 | 6 | 21 SEQ ID NO. 862 |
| (N20)NGG | 11 | 5248040 | + | AGAACTTCAGGGTGAGTCTATGG |  | 1 | 15 | 83 SEQ ID NO. 863 |
| (N20)NGG | 11 | 5248041 | + | GAACTTCAGGGTGAGTCTATGGG |  | 1 | 5 | 32 SEQ ID NO. 864 |
| (N20)NGG | 11 | 5247795 | − | ACCACCAGCAGCCTAAGGGTGGG |  | 1 | 1 | 26 SEQ ID NO. 865 |
| (N20)NGG | 11 | 5247796 | − | GACCACCAGCAGCCTAAGGGTGG |  | 1 | 4 | 36 SEQ ID NO. 866 |
| (N20)NGG | 11 | 5247799 | − | GTAGACCACCAGCAGCCTAAGG |  | 1 | 2 | 24 SEQ ID NO. 867 |
| (N20)NGG | 11 | 5247800 | − | GGTAGACCACCAGCAGCCTAAGG |  | 1 | 2 | 20 SEQ ID NO. 868 |
| (N20)NGG | 11 | 5247821 | − | CAAAGAACCTCTGGGTCCAAGG |  | 4 | 8 | 41 SEQ ID NO. 869 |
| (N20)NGG | 11 | 5247822 | − | TCAAAGAACCTCTGGGTCCAAGG |  | 5 | 11 | 32 SEQ ID NO. 870 |
| (N20)NGG | 11 | 5247829 | − | AAAGGACTCAAAGAACCTCTGG |  | 2 | 7 | 59 SEQ ID NO. 871 |
| (N20)NGG | 11 | 5247830 | − | CAAAGGACTCAAAGAACCTCTGG |  | 2 | 6 | 61 SEQ ID NO. 872 |
| (N20)NGG | 11 | 5247847 | − | AGGAGTGGACAGATCCCCAAAGG |  | 2 | 3 | 38 SEQ ID NO. 873 |
| (N20)NGG | 11 | 5247862 | − | GCCCATAACAGCATCAGGAGTGG |  | 2 | 2 | 42 SEQ ID NO. 874 |
| (N20)NGG | 11 | 5247857 | − | GGGTTGCCCATAACAGCATCAGG |  | 2 | 2 | 11 SEQ ID NO. 875 |
| (N20)NGG | 11 | 5247887 | − | TGCCATGAGCCTTCACCTTAGG |  | 2 | 2 | 32 SEQ ID NO. 876 |
| (N20)NGG | 11 | 5247888 | − | TTGCCATGAGCCTTCACCTTAGG |  | 2 | 4 | 35 SEQ ID NO. 877 |
| (N20)NGG | 11 | 5247925 | − | GTGAGCCAGGCCATCACTAAAGG |  | 2 | 2 | 23 SEQ ID NO. 878 |
| (N20)NGG | 11 | 5247938 | − | TGAGGTTGTCCAGGTGAGCCAGG |  | 2 | 7 | 55 SEQ ID NO. 879 |

FIG. 5 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 5247947 | - | AGGTGCCCTTGAGGTTGTCCAGG | 2 | 3 | 19 | SEQ ID NO. 880 |
| (N20)NGG | 11 | 5247956 | - | GTGTGGCAAAGTGCCCTTGAGG | 1 | 2 | 36 | SEQ ID NO. 881 |
| (N20)NGG | 11 | 5247967 | - | CAGCTCACTCAGTGTGGCAAAGG | 1 | 4 | 40 | SEQ ID NO. 882 |
| (N20)NGG | 11 | 5247973 | - | ACAGTGCAGCTCACTCAGTGTGG | 2 | 8 | 46 | SEQ ID NO. 883 |
| (N20)NGG | 11 | 5248014 | - | AGACTCACCCTGAAGTTCTCAGG | 2 | 7 | 74 | SEQ ID NO. 884 |
| (N20)NGG | 11 | 5248162 | + | GCAACCTCAAACAGACACCATGG | 2 | 3 | 35 | SEQ ID NO. 885 |
| (N20)NGG | 11 | 5248180 | + | CATGGTGCATCTGACTCCTGAGG | 2 | 6 | 43 | SEQ ID NO. 886 |
| (N20)NGG | 11 | 5248206 | + | AGTCTGCCGTTACTGCCCTGTGG | 1 | 3 | 20 | SEQ ID NO. 887 |
| (N20)NGG | 11 | 5248207 | + | GTCTGCCGTTACTGCCCTGTGGG | 1 | 2 | 12 | SEQ ID NO. 888 |
| (N20)NGG | 11 | 5248208 | + | TCTGCCGTTACTGCCCTGTGGGG | 1 | 3 | 32 | SEQ ID NO. 889 |
| (N20)NGG | 11 | 5248213 | + | CGTTACTGCCCTGTGGGCAAGG | 1 | 2 | 18 | SEQ ID NO. 890 |
| (N20)NGG | 11 | 5248222 | + | CCTGTGGGCAAGGTGAACGTGG | 4 | 5 | 33 | SEQ ID NO. 891 |
| (N20)NGG | 11 | 5248232 | + | AAGGTGAACGTGGATGAAGTTGG | 1 | 3 | 34 | SEQ ID NO. 892 |
| (N20)NGG | 11 | 5248235 | + | GTGAACGTGGATGAAGTTGGTGG | 2 | 9 | 139 | SEQ ID NO. 893 |
| (N20)NGG | 11 | 5248240 | + | CGTGGATGAAGTTGGTGGTGAGG | 2 | 4 | 30 | SEQ ID NO. 894 |
| (N20)NGG | 11 | 5248246 | + | TGAAGTTGGTGGTGAGGCCCTGG | 2 | 5 | 49 | SEQ ID NO. 895 |
| (N20)NGG | 11 | 5248247 | + | GAAGTTGGTGGTGAGGCCCTGGG | 2 | 5 | 46 | SEQ ID NO. 896 |
| (N20)NGG | 11 | 5248251 | + | TTGGTGGTGAGGCCCTGGGCAGG | 2 | 13 | 109 | SEQ ID NO. 897 |
| (N20)NGG | 11 | 5248255 | + | TGGTGAGGCCCTGGGCAGGTTGG | 3 | 14 | 130 | SEQ ID NO. 898 |
| (N20)NGG | 11 | 5248263 | + | CCCTGGGCAGGTTGGTATCAAGG | 2 | 2 | 38 | SEQ ID NO. 899 |
| (N20)NGG | 11 | 5248275 | + | TGGTATCAAGGTTACAAGACAGG | 1 | 5 | 45 | SEQ ID NO. 900 |
| (N20)NGG | 11 | 5248144 | - | TGCACCATGGTGTCTGTTTGAGG | 2 | 5 | 45 | SEQ ID NO. 901 |
| (N20)NGG | 11 | 5248157 | - | CTCAGGAGTCAGATGCACCATGG | 2 | 7 | 85 | SEQ ID NO. 902 |
| (N20)NGG | 11 | 5248174 | - | GTAACGGCAGACTTCTCCTCAGG | 1 | 1 | 11 | SEQ ID NO. 903 |
| (N20)NGG | 11 | 5248190 | - | CTTGCCCACAGGGCAGTAACGG | 1 | 2 | 48 | SEQ ID NO. 904 |
| (N20)NGG | 11 | 5248199 | - | CACGTTCACCTTGCCCACAGGG | 2 | 4 | 22 | SEQ ID NO. 905 |
| (N20)NGG | 11 | 5248200 | - | CCAAGTTCACCTTGCCCACAGG | 4 | 5 | 26 | SEQ ID NO. 906 |
| (N20)NGG | 11 | 5248241 | - | CCTTGATACCAACCTGCCCAGG | 2 | 2 | 16 | SEQ ID NO. 907 |
| (N20)NGG | 11 | 5248242 | - | ACCTTGATACCAACCTGCCCAGG | 2 | 2 | 20 | SEQ ID NO. 908 |

FIG. 5 cont.

| site_type | site_chromosome | site_start_nucleotide | site_strand | target_site_sequence with NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | X | 70327585 | + | ACCTGGACATATCTGTCTTTAGG | 1 | 4 | 62 | SEQ ID NO. 909 |
| (N20)NGG | X | 70327590 | + | GACATATCTGTCTTTAGGCCTGG | 1 | 2 | 39 | SEQ ID NO. 910 |
| (N20)NGG | X | 70327595 | + | ATCTGTCTTTAGGCCTGGAGTGG | 1 | 2 | 52 | SEQ ID NO. 911 |
| (N20)NGG | X | 70327606 | + | GGCCTGGAGTGGTGTGTCTAAGG | 1 | 4 | 54 | SEQ ID NO. 912 |
| (N20)NGG | X | 70327607 | + | GCCTGGAGTGGTGTGTCTAAGGG | 1 | 2 | 45 | SEQ ID NO. 913 |
| (N20)NGG | X | 70327612 | + | GAGTGGTGTGTCTAAGGGACTGG | 1 | 1 | 32 | SEQ ID NO. 914 |
| (N20)NGG | X | 70327676 | + | GTCAGTGAGATTCCCCCAAAAGG | 1 | 2 | 30 | SEQ ID NO. 915 |
| (N20)NGG | X | 70327679 | + | AGTGAGATTCCCCCAAAAGGAGG | 1 | 4 | 51 | SEQ ID NO. 916 |
| (N20)NGG | X | 70327680 | + | GTGAGATTCCCCCAAAAGGAGGG | 1 | 2 | 59 | SEQ ID NO. 917 |
| (N20)NGG | X | 70327681 | + | TGAGATTCCCCCAAAAGGAGGGG | 1 | 3 | 53 | SEQ ID NO. 918 |
| (N20)NGG | X | 70327688 | + | CCCCCAAAAGGAGGGGCCCTTGG | 1 | 3 | 28 | SEQ ID NO. 919 |
| (N20)NGG | X | 70327689 | + | CCCCAAAAGGAGGGGCCCTTTGG | 1 | 1 | 33 | SEQ ID NO. 920 |
| (N20)NGG | X | 70327690 | + | CCCAAAAGGAGGGGCCCTTTGGG | 1 | 3 | 33 | SEQ ID NO. 921 |
| (N20)NGG | X | 70327693 | + | AAAAGGAGGGGCCCTTTGGGAGG | 1 | 3 | 95 | SEQ ID NO. 922 |
| (N20)NGG | X | 70327694 | + | AAAGGAGGGGCCCTTTGGGAGGG | 1 | 10 | 110 | SEQ ID NO. 923 |
| (N20)NGG | X | 70327695 | + | AAGGAGGGGCCCTTTGGGAGGGG | 2 | 8 | 140 | SEQ ID NO. 924 |
| (N20)NGG | X | 70327700 | + | GGGGCCCTTTGGGAGGGGCCTGG | 1 | 30 | 212 | SEQ ID NO. 925 |
| (N20)NGG | X | 70327701 | + | GGGCCCTTTGGGAGGGGCCTGGG | 1 | 16 | 187 | SEQ ID NO. 926 |
| (N20)NGG | X | 70327702 | + | GGCCCTTTGGGAGGGGCCTGGGG | 4 | 30 | 206 | SEQ ID NO. 927 |
| (N20)NGG | X | 70327734 | + | GCAACCAGCATAGCCCCTACTGG | 1 | 3 | 14 | SEQ ID NO. 928 |
| (N20)NGG | X | 70327735 | + | CAACCAGCATAGCCCCTACTGGG | 1 | 1 | 13 | SEQ ID NO. 929 |
| (N20)NGG | X | 70327564 | – | GCCTAAAGACAGATATGTCCAGG | 1 | 3 | 24 | SEQ ID NO. 930 |
| (N20)NGG | X | 70327586 | – | TCCCTTAGACACCACTCCAGG | 1 | 2 | 26 | SEQ ID NO. 931 |
| (N20)NGG | X | 70327627 | – | CAGAGTCGTTCACTGTAGTCTGG | 1 | 2 | 69 | SEQ ID NO. 932 |
| (N20)NGG | X | 70327650 | – | TTGGGGAATCTCACTGACGAGG | 1 | 2 | 16 | SEQ ID NO. 933 |
| (N20)NGG | X | 70327666 | – | CCAAGGCCCCTCCTTTTTGGGGG | 1 | 4 | 39 | SEQ ID NO. 934 |
| (N20)NGG | X | 70327667 | – | CCCAAGGCCCCTCCTTTTTGGGG | 1 | 4 | 51 | SEQ ID NO. 935 |
| (N20)NGG | X | 70327668 | – | CCCCAAGGCCCCTCCTTTTTGGG | 1 | 4 | 44 | SEQ ID NO. 936 |
| (N20)NGG | X | 70327669 | – | TCCCCAAGGCCCCTCCTTTTTGG | 2 | 2 | 53 | SEQ ID NO. 937 |
| (N20)NGG | X | 70327682 | – | GGCCCCAGGCCCCTCCCCAAGGG | 5 | 10 | 147 | SEQ ID NO. 938 |
| (N20)NGG | X | 70327683 | – | AGGCCCCAGGCCCCTCCCCAAGG | 1 | 22 | 285 | SEQ ID NO. 939 |
| (N20)NGG | X | 70327696 | – | TGGTTGCATGGGAGGCCCCAGG | 1 | 1 | 74 | SEQ ID NO. 940 |
| (N20)NGG | X | 70327703 | – | GCTATGCTGGTTGCATGGGAGG | 1 | 3 | 22 | SEQ ID NO. 941 |
| (N20)NGG | X | 70327706 | – | GGGGCTATGCTGGTTGCATGGGG | 1 | 1 | 26 | SEQ ID NO. 942 |

FIG. 6

| site_type | site_chromosome | site_start_nucleotide | site_strand | target_site_sequence_with NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | X | 70327707 | - | AGGGGCTATGCTGGTTGCATGGG | 1 | 3 | 29 | SEQ ID NO. 943 |
| (N20)NGG | X | 70327708 | - | TAGGGGCTATGCTGGTTGCATGG | 1 | 3 | 28 | SEQ ID NO. 944 |
| (N20)NGG | X | 70327716 | - | GGGCCCAGTAGGGGCTATGCTGG | 1 | 1 | 20 | SEQ ID NO. 945 |
| (N20)NGG | X | 70327725 | - | AACATGGGGGGGCCCAGTAGGGG | 1 | 1 | 23 | SEQ ID NO. 946 |
| (N20)NGG | X | 70327726 | - | TAACATGGGGGGGCCCAGTAGGG | 1 | 1 | 6 | SEQ ID NO. 947 |
| (N20)NGG | X | 70327727 | - | GTAACATGGGGGGGCCCAGTAGG | 1 | 1 | 15 | SEQ ID NO. 948 |
| (N20)NGG | X | 70327736 | - | CTTTAGGGTGTAACATGGGGGGG | 1 | 1 | 19 | SEQ ID NO. 949 |
| (N20)NGG | X | 70327737 | - | GCTTTAGGGTGTAACATGGGGGG | 1 | 2 | 17 | SEQ ID NO. 950 |
| (N20)NGG | X | 70327738 | - | GGCTTTAGGGTGTAACATGGGGG | 1 | 1 | 16 | SEQ ID NO. 951 |
| (N20)NGG | X | 70327739 | - | AGGCTTTAGGGTGTAACATGGGG | 1 | 2 | 23 | SEQ ID NO. 952 |
| (N20)NGG | X | 70327740 | - | CAGGCTTTAGGGTGTAACATGGG | 1 | 1 | 17 | SEQ ID NO. 953 |
| (N20)NGG | X | 70327741 | - | TCAGGCTTTAGGGTGTAACATGG | 1 | 2 | 24 | SEQ ID NO. 954 |
| (N20)NGG | X | 70327751 | - | GGTTCAGGTTTCAGGCTTTAGGG | 1 | 2 | 50 | SEQ ID NO. 955 |
| (N20)NGG | X | 70327752 | - | GGGATTGGGGTTCAGGTTTCAGG | 1 | 7 | 64 | SEQ ID NO. 956 |
| (N20)NGG | X | 70327759 | - | AGGATTGGGGTTCAGGTTTCAGG | 1 | 3 | 35 | SEQ ID NO. 957 |
| (N20)NGG | X | 70327766 | - | CTGTCAGAGAGATTGGGGTTCAGG | 1 | 6 | 51 | SEQ ID NO. 958 |
| (N20)NGG | X | 70327772 | - | GTTCTTCTGTCAGAGGATTGGGG | 1 | 3 | 46 | SEQ ID NO. 959 |
| (N20)NGG | X | 70327773 | - | GGTTCTTCTGTCAGAGGATTGGG | 1 | 4 | 33 | SEQ ID NO. 960 |
| (N20)NGG | X | 70328126 | + | CTCCCTCTTTCTCCCCTGTCAGG | 1 | 15 | 220 | SEQ ID NO. 961 |
| (N20)NGG | X | 70328163 | + | TCCACCCTGAAGAACCTAGAGG | 1 | 2 | 23 | SEQ ID NO. 962 |
| (N20)NGG | X | 70328185 | + | GATCTTGTTACTGAATACCACGG | 1 | 3 | 34 | SEQ ID NO. 963 |
| (N20)NGG | X | 70328186 | + | ATCTTGTTACTGAATACCACGGG | 1 | 2 | 24 | SEQ ID NO. 964 |
| (N20)NGG | X | 70328196 | + | TGAATACCACGGGAACTTTTCGG | 1 | 2 | 17 | SEQ ID NO. 965 |
| (N20)NGG | X | 70328106 | - | GTCCTGACAGGGGAGAAAGAGGG | 1 | 6 | 137 | SEQ ID NO. 966 |
| (N20)NGG | X | 70328107 | - | CGTCCTGACAGGGGAGAAAGAGG | 1 | 5 | 48 | SEQ ID NO. 967 |
| (N20)NGG | X | 70328116 | - | TCGGGGCATCGTCCTGACAGGGG | 1 | 1 | 8 | SEQ ID NO. 968 |
| (N20)NGG | X | 70328117 | - | TTCGGGGCATCGTCCTGACAGGG | 1 | 1 | 7 | SEQ ID NO. 969 |
| (N20)NGG | X | 70328118 | - | ATTCGGGGCATCGTCCTGACAGG | 1 | 1 | 2 | SEQ ID NO. 970 |
| (N20)NGG | X | 70328133 | - | TTCTTCAGGGTGGGAATTCGGGG | 1 | 1 | 33 | SEQ ID NO. 971 |
| (N20)NGG | X | 70328134 | - | GTTCTTCAGGGTGGGAATTCGGG | 2 | 3 | 62 | SEQ ID NO. 972 |
| (N20)NGG | X | 70328135 | - | GGTTCTTCAGGGTGGGAATTCGG | 1 | 6 | 42 | SEQ ID NO. 973 |
| (N20)NGG | X | 70328142 | - | TCCTCTAGGTTCTTCAGGGTGGG | 1 | 2 | 39 | SEQ ID NO. 974 |
| (N20)NGG | X | 70328143 | - | ATCCTCTAGGTTCTTCAGGGTGG | 1 | 2 | 36 | SEQ ID NO. 975 |
| (N20)NGG | X | 70328146 | - | AAGATCCTCTAGGTTCTTCAGGG | 1 | 2 | 48 | SEQ ID NO. 976 |

FIG. 6 cont.

| site type | site chromosome | site start nucleotide | site strand | target site sequence with NGG | genome wide hits with 1 or less mismatches | genome wide hits with 2 or less mismatches | genome wide hits with 3 or less mismatches | | |
|---|---|---|---|---|---|---|---|---|---|
| (N20)NGG | X | 70328147 | - | CAAGATCCTCTAGGTTCTTCAGG | 1 | 2 | 54 | SEQ ID NO. | 977 |
| (N20)NGG | X | 70328156 | - | ATTCAGTAACAAGATCCTCTAGG | 1 | 4 | 33 | SEQ ID NO. | 978 |
| (N20)NGG | X | 70328180 | - | TTCTCACCGAAAAGTTCCCGTGG | 1 | 1 | 9 | SEQ ID NO. | 979 |
| (N20)NGG | X | 70328471 | + | GAATCCTTTCCTGTTTGCATTGG | 1 | 4 | 54 | SEQ ID NO. | 980 |
| (N20)NGG | X | 70328480 | + | CCTGTTTGCATTGGAAGCCGTGG | 2 | 3 | 18 | SEQ ID NO. | 981 |
| (N20)NGG | X | 70328493 | + | GAAGCCGTGGTTATCTCTGTTGG | 1 | 1 | 16 | SEQ ID NO. | 982 |
| (N20)NGG | X | 70328501 | + | GGTTATCTCTGTTGGCTCCATGG | 1 | 1 | 36 | SEQ ID NO. | 983 |
| (N20)NGG | X | 70328502 | + | GTTATCTCTGTTGGCTCCATGGG | 1 | 5 | 55 | SEQ ID NO. | 984 |
| (N20)NGG | X | 70328536 | + | GCCTTCTCTGTGTATTTCTGG | 1 | 2 | 83 | SEQ ID NO. | 985 |
| (N20)NGG | X | 70328540 | + | TCTCTGTGTATTTCTGGCTGG | 2 | 9 | 112 | SEQ ID NO. | 986 |
| (N20)NGG | X | 70328545 | + | GTGTATTTCTGGCTGGAACGG | 1 | 5 | 78 | SEQ ID NO. | 987 |
| (N20)NGG | X | 70328555 | + | CTGGCTGGAACGGTGAGATTTGG | 1 | 3 | 14 | SEQ ID NO. | 988 |
| (N20)NGG | X | 70328453 | - | GCTTCCAATGCAAACAGGAAAGG | 1 | 1 | 54 | SEQ ID NO. | 989 |
| (N20)NGG | X | 70328458 | - | CCACGGCTTCCAATGCAAACAGG | 2 | 3 | 18 | SEQ ID NO. | 990 |
| (N20)NGG | X | 70328475 | - | GGAGCCAACAGAGATAACCACGG | 1 | 3 | 43 | SEQ ID NO. | 991 |
| (N20)NGG | X | 70328496 | - | AAGGCTGATAATCAATCCCATGG | 1 | 2 | 29 | SEQ ID NO. | 992 |
| (N20)NGG | X | 70328515 | - | GCCAGAAATACACACAGAGAAGG | 1 | 16 | 277 | SEQ ID NO. | 993 |
| (N20)NGG | X | 70329077 | + | CCTCATCCTCTTTCTCCTCAAGG | 2 | 27 | 343 | SEQ ID NO. | 994 |
| (N20)NGG | X | 70329089 | + | TCTCCTCAAGGAACAATCAGTGG | 1 | 1 | 33 | SEQ ID NO. | 995 |
| (N20)NGG | X | 70329122 | + | TAAGTTCTCCTTGCCTAGTGTGG | 1 | 2 | 29 | SEQ ID NO. | 996 |
| (N20)NGG | X | 70329126 | + | TTTCCTTGCCTAGTGTGGATGG | 1 | 4 | 66 | SEQ ID NO. | 997 |
| (N20)NGG | X | 70329127 | + | TCTCCTTGCCTAGTGTGGATGGG | 1 | 4 | 32 | SEQ ID NO. | 998 |
| (N20)NGG | X | 70329154 | + | AACGCTACACGTTTCGTGTTCGG | 1 | 1 | 2 | SEQ ID NO. | 999 |
| (N20)NGG | X | 70329177 | + | AGCCGCTTAACCACCTCTGTGG | 1 | 1 | 10 | SEQ ID NO. | 1000 |
| (N20)NGG | X | 70329193 | + | TCTGTGGAAGTGCTCAGCATTGG | 2 | 5 | 51 | SEQ ID NO. | 1001 |
| (N20)NGG | X | 70329202 | + | GTGCTCAGCATTGGAGTGAATGG | 1 | 2 | 36 | SEQ ID NO. | 1002 |
| (N20)NGG | X | 70329220 | + | AATGGAGCCACCCAATCCACTGG | 2 | 2 | 23 | SEQ ID NO. | 1003 |
| (N20)NGG | X | 70329221 | + | ATGGAGCCACCCAATCCACTGGG | 1 | 1 | 24 | SEQ ID NO. | 1004 |
| (N20)NGG | X | 70329222 | + | TGGAGCCACCCAATCCACTGGGG | 1 | 1 | 46 | SEQ ID NO. | 1005 |
| (N20)NGG | X | 70329223 | + | GGAGCCACCCAATCCACTGGGGG | 1 | 1 | 36 | SEQ ID NO. | 1006 |
| (N20)NGG | X | 70329240 | + | TGGGGAGCAATACTTCAAAAGG | 1 | 1 | 29 | SEQ ID NO. | 1007 |
| (N20)NGG | X | 70329248 | + | CAATACTTCAAAAGGTAAAATGG | 2 | 7 | 167 | SEQ ID NO. | 1008 |
| (N20)NGG | X | 70329249 | + | AATACTTCAAAAGGTAAAATGGG | 2 | 11 | 213 | SEQ ID NO. | 1009 |
| (N20)NGG | X | 70329054 | - | CTTGAGGAGAAAGAGGATGAGGG | 2 | 10 | 183 | SEQ ID NO. | 1010 |

FIG. 6 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | X | 70329055 | - | CCTTGAGGAGAAAGAGGATGAGG | 1 | 16 | 187 | SEQ ID NO. 1011 |
| (N20)NGG | X | 70329061 | - | ATTGTTCCTTGAGGAGAAAGAGG | 1 | 5 | 77 | SEQ ID NO. 1012 |
| (N20)NGG | X | 70329070 | - | AATCCACTGATTGTTCCTTGAGG | 1 | 3 | 31 | SEQ ID NO. 1013 |
| (N20)NGG | X | 70329108 | - | CTGCCCATCCACACTAGGCAAGG | 1 | 6 | 51 | SEQ ID NO. 1014 |
| (N20)NGG | X | 70329113 | - | CGTTTCTGCCCATCCACACTAGG | 1 | 1 | 18 | SEQ ID NO. 1015 |
| (N20)NGG | X | 70329157 | - | TTCCACAGAGTGGGTTAAAGCGG | 1 | 1 | 39 | SEQ ID NO. 1016 |
| (N20)NGG | X | 70329166 | - | GCTGAGCACTTCCACAGAGTGG | 1 | 3 | 36 | SEQ ID NO. 1017 |
| (N20)NGG | X | 70329167 | - | TGCTGAGCACTTCCACAGAGTGG | 2 | 8 | 90 | SEQ ID NO. 1018 |
| (N20)NGG | X | 70329205 | - | TGCTCCCCAGTGGATTGGGTGG | 1 | 4 | 50 | SEQ ID NO. 1019 |
| (N20)NGG | X | 70329208 | - | TATTGCTCCCCAGTGGATTGGG | 1 | 3 | 20 | SEQ ID NO. 1020 |
| (N20)NGG | X | 70329209 | - | GTATTGCTCCCCAGTGGATTGG | 1 | 2 | 18 | SEQ ID NO. 1021 |
| (N20)NGG | X | 70329214 | - | TTGAAGTATTGCTCCCCAGTGG | 1 | 1 | 18 | SEQ ID NO. 1022 |
| (N20)NGG | X | 70330015 | + | ACATATCTCCAGTGATCCCCTGG | 1 | 3 | 31 | SEQ ID NO. 1023 |
| (N20)NGG | X | 70330016 | + | CATATCTCCAGTGATCCCCTGGG | 1 | 1 | 31 | SEQ ID NO. 1024 |
| (N20)NGG | X | 70330072 | + | AATCCCAGTAGAACTGAACTGG | 1 | 4 | 32 | SEQ ID NO. 1025 |
| (N20)NGG | X | 70330100 | + | CAGATTCTTGAACCACTGTTTGG | 1 | 4 | 44 | SEQ ID NO. 1026 |
| (N20)NGG | X | 70330109 | + | GAACCACTGTTTGGAGCACTTGG | 1 | 3 | 36 | SEQ ID NO. 1027 |
| (N20)NGG | X | 70330120 | + | TGGAGCACTTGGTGCAGTACCGG | 1 | 3 | 23 | SEQ ID NO. 1028 |
| (N20)NGG | X | 70330129 | + | TGGTGCAGTACCGGACTGACTGG | 1 | 2 | 8 | SEQ ID NO. 1029 |
| (N20)NGG | X | 70330130 | + | GGTGCAGTACCGGACTGACTGGG | 1 | 1 | 1 | SEQ ID NO. 1030 |
| (N20)NGG | X | 70330141 | + | GGACTGACTGGGACCACAGCTGG | 1 | 4 | 50 | SEQ ID NO. 1031 |
| (N20)NGG | X | 70330157 | + | CAGCTGGACTGTGAGTGACTAGG | 1 | 2 | 57 | SEQ ID NO. 1032 |
| (N20)NGG | X | 70330158 | + | AGCTGGACTGTGAGTGACTAGGG | 1 | 2 | 35 | SEQ ID NO. 1033 |
| (N20)NGG | X | 70329981 | - | TGGAGATATGTGTGCATATGTGG | 1 | 11 | 182 | SEQ ID NO. 1034 |
| (N20)NGG | X | 70330001 | - | TCTGGAGCCCAGGGATCACTGG | 1 | 2 | 61 | SEQ ID NO. 1035 |
| (N20)NGG | X | 70330009 | - | TTAGCTTCTCTGGAGCCCAGGGG | 1 | 8 | 215 | SEQ ID NO. 1036 |
| (N20)NGG | X | 70330010 | - | GTTAGGTTCTCTGGAGCCCAGG | 1 | 4 | 40 | SEQ ID NO. 1037 |
| (N20)NGG | X | 70330011 | - | TGTTAGGTTCTCTGGAGCCCAGG | 1 | 4 | 112 | SEQ ID NO. 1038 |
| (N20)NGG | X | 70330019 | - | TTGTGAAGTGTTAGGTTCTCTGG | 1 | 1 | 31 | SEQ ID NO. 1039 |
| (N20)NGG | X | 70330027 | - | CACTCAGTTTGTGAAGTGTTAGG | 1 | 3 | 36 | SEQ ID NO. 1040 |
| (N20)NGG | X | 70330053 | - | GTTCCAGTTCAGTTCTAGCTGGG | 1 | 2 | 29 | SEQ ID NO. 1041 |
| (N20)NGG | X | 70330054 | - | TGTTCCAGTTCAGTTCTAGCTGG | 1 | 2 | 21 | SEQ ID NO. 1042 |
| (N20)NGG | X | 70330090 | - | GCACCAAGTGCTCCAAACAGTGG | 1 | 2 | 25 | SEQ ID NO. 1043 |
| (N20)NGG | X | 70330117 | - | AGCTGTGGTCCCAGTCAGTCCGG | 1 | 16 | 472 | SEQ ID NO. 1044 |

FIG. 6 cont.

| site type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | X | 70330132 | - | AGTCACTCACAGTCCAGCTGTGG | 1 | 5 | 52 | SEQ ID NO. 1045 |
| (N20)NGG | X | 70330353 | + | CCTTCCAACCTTTCTCCTCTAGG | 1 | 8 | 135 | SEQ ID NO. 1046 |
| (N20)NGG | X | 70330366 | + | CTCCTCTAGGTACAAGAACTCGG | 1 | 1 | 26 | SEQ ID NO. 1047 |
| (N20)NGG | X | 70330424 | + | TTCTCTGAAGAAATCACTTCTGG | 2 | 8 | 90 | SEQ ID NO. 1048 |
| (N20)NGG | X | 70330444 | + | TGGCTGTCAGTTGCAAAAAAAGG | 1 | 2 | 57 | SEQ ID NO. 1049 |
| (N20)NGG | X | 70330483 | + | AACATTTGTTGTTCAGCTCCAGG | 1 | 4 | 43 | SEQ ID NO. 1050 |
| (N20)NGG | X | 70330491 | + | TTGTTCAGCTCCAGGACCCACGG | 1 | 4 | 38 | SEQ ID NO. 1051 |
| (N20)NGG | X | 70330492 | + | TGTTCAGCTCCAGGACCCACGGG | 1 | 2 | 39 | SEQ ID NO. 1052 |
| (N20)NGG | X | 70330500 | + | TCCAGGACCCACGGGAACCCAGG | 1 | 6 | 53 | SEQ ID NO. 1053 |
| (N20)NGG | X | 70330507 | + | CCCACGGGAACCCAGGAGACAGG | 1 | 1 | 42 | SEQ ID NO. 1054 |
| (N20)NGG | X | 70330537 | + | GATGCTAAAACTGCAGAATCTGG | 2 | 7 | 55 | SEQ ID NO. 1055 |
| (N20)NGG | X | 70330538 | + | ATGCTAAAACTGCAGAATCTGGG | 3 | 20 | 217 | SEQ ID NO. 1056 |
| (N20)NGG | X | 70330546 | + | ACTGCAGAATCTGGGTAATTTGG | 1 | 2 | 48 | SEQ ID NO. 1057 |
| (N20)NGG | X | 70330555 | + | TCTGGGTAATTTGGAAAGAAAGG | 9 | 482 | 8109 | SEQ ID NO. 1058 |
| (N20)NGG | X | 70330556 | + | CTGGGTAATTTGGAAAGAAAGGG | 126 | 2902 | 13176 | SEQ ID NO. 1059 |
| (N20)NGG | X | 70330331 | - | CCTACAGGAGAAAGGTTCGAAGG | 1 | 5 | 75 | SEQ ID NO. 1060 |
| (N20)NGG | X | 70330335 | - | TGTACCTAGAGGAGAAAGGTTGG | 1 | 4 | 52 | SEQ ID NO. 1061 |
| (N20)NGG | X | 70330339 | - | TTCTTGTACCTAGAGGAGAAAGG | 1 | 2 | 43 | SEQ ID NO. 1062 |
| (N20)NGG | X | 70330346 | - | ATCCGAGTTCTTGTACCTAGAGG | 1 | 1 | 7 | SEQ ID NO. 1063 |
| (N20)NGG | X | 70330380 | - | ATAGATAGTGGCTGCACTTCTGG | 1 | 2 | 21 | SEQ ID NO. 1064 |
| (N20)NGG | X | 70330392 | - | TTTCTTCAGAGAATAGATAGTGG | 1 | 6 | 86 | SEQ ID NO. 1065 |
| (N20)NGG | X | 70330449 | - | CAACAAATGTTTGGTAGAGGTGG | 1 | 4 | 64 | SEQ ID NO. 1066 |
| (N20)NGG | X | 70330452 | - | GAACAACAAATGTTTGGTAGAGG | 1 | 5 | 45 | SEQ ID NO. 1067 |
| (N20)NGG | X | 70330458 | - | GGAGCTGAACAACAAATGTTTGG | 1 | 1 | 48 | SEQ ID NO. 1068 |
| (N20)NGG | X | 70330479 | - | TCCTGGGTTCCCGTGGGTCCTGG | 1 | 2 | 68 | SEQ ID NO. 1069 |
| (N20)NGG | X | 70330485 | - | CCTGTCTCCTGGGTTCCCGTGGG | 1 | 2 | 111 | SEQ ID NO. 1070 |
| (N20)NGG | X | 70330486 | - | GCCTGTCTCCTGGGTTCCCGTGG | 1 | 6 | 77 | SEQ ID NO. 1071 |
| (N20)NGG | X | 70330495 | - | ATCTGTGTGGCCTGTCTCTCTGG | 1 | 7 | 72 | SEQ ID NO. 1072 |
| (N20)NGG | X | 70330496 | - | CATCTGTGTGGCCTGTCTCCTGG | 1 | 5 | 62 | SEQ ID NO. 1073 |
| (N20)NGG | X | 70330508 | - | CTGCAGTTTTAGCATCTGTGTGG | 1 | 10 | 89 | SEQ ID NO. 1074 |
| (N20)NGG | X | 70330808 | + | TTCCACTCTGCCCCTCCCAGAGG | 3 | 7 | 115 | SEQ ID NO. 1075 |
| (N20)NGG | X | 70330852 | + | TCGAGTACATGAATTGCACTTGG | 1 | 1 | 9 | SEQ ID NO. 1076 |
| (N20)NGG | X | 70330900 | + | CCAACCTCACTCTGCATTATTGG | 1 | 6 | 42 | SEQ ID NO. 1077 |
| (N20)NGG | X | 70330910 | + | TCTGCATTATTGGTATGAGAAGG | 1 | 4 | 36 | SEQ ID NO. 1078 |

FIG. 6 cont.

| site type | site chromosome | site start nucleotide | site strand | target site sequence with NGG | genome wide hits with 1 or less mismatches | genome wide hits with 2 or less mismatches | genome wide hits with 3 or less mismatches | |
|---|---|---|---|---|---|---|---|---|
| (N20)NGG | X | 70330911 | + | CTGCATTATTGGTATCAGAAGGG | | 1 | 2 | 42 SEQ ID NO. 1079 |
| (N20)NGG | X | 70330917 | + | TATTGGTATGAGAAGGGACGAGG | | 1 | 2 | 23 SEQ ID NO. 1080 |
| (N20)NGG | X | 70330918 | + | ATTGGTATGAGAAGGGACGAGGG | | 1 | 1 | 23 SEQ ID NO. 1081 |
| (N20)NGG | X | 70330919 | + | TTGGTATGAGAAGGGACGAGGGG | | 1 | 3 | 25 SEQ ID NO. 1082 |
| (N20)NGG | X | 70330920 | + | TGGTATGAGAAGGGACGAGGGGG | | 2 | 6 | 57 SEQ ID NO. 1083 |
| (N20)NGG | X | 70330923 | + | TATGAGAAGGGACGAGGGGGAGG | | 1 | 6 | 62 SEQ ID NO. 1084 |
| (N20)NGG | X | 70330924 | + | ATGAGAAGGGACGAGGGGGAGGG | | 1 | 5 | 168 SEQ ID NO. 1085 |
| (N20)NGG | X | 70330723 | - | CTAGATTGGGGAGAAAATGAAGG | | 1 | 8 | 128 SEQ ID NO. 1086 |
| (N20)NGG | X | 70330735 | - | TCAGGAAGAAATCTAGATTGGGG | | 1 | 8 | 83 SEQ ID NO. 1087 |
| (N20)NGG | X | 70330736 | - | GTCAGGAAGAAATCTAGATTGGG | | 1 | 3 | 68 SEQ ID NO. 1088 |
| (N20)NGG | X | 70330737 | - | GGTCAGGAAGAAATCTAGATTGG | | 1 | 3 | 50 SEQ ID NO. 1089 |
| (N20)NGG | X | 70330753 | - | AGTCAGTGGGCATAGTGGTCAGG | | 1 | 2 | 42 SEQ ID NO. 1090 |
| (N20)NGG | X | 70330758 | - | GAGGGAGTCAGTGGGCATAGTGG | | 1 | 4 | 82 SEQ ID NO. 1091 |
| (N20)NGG | X | 70330766 | - | GAAACACTGAGGGAGTCAGTGGG | | 1 | 2 | 68 SEQ ID NO. 1092 |
| (N20)NGG | X | 70330767 | - | GAAACACTGAGGGAGTCAGTGG | | 1 | 6 | 81 SEQ ID NO. 1093 |
| (N20)NGG | X | 70330776 | - | GGGCAGAGTGGAAACACTGAGGG | | 2 | 6 | 93 SEQ ID NO. 1094 |
| (N20)NGG | X | 70330777 | - | GGGGCAGAGTGGAAACACTGAGG | | 2 | 8 | 95 SEQ ID NO. 1095 |
| (N20)NGG | X | 70330788 | - | AACCTCTGGGGCGGCAGAGTGG | | 1 | 6 | 132 SEQ ID NO. 1096 |
| (N20)NGG | X | 70330796 | - | AAACACTGAACCTCTGGGAGGG | | 1 | 3 | 46 SEQ ID NO. 1097 |
| (N20)NGG | X | 70330797 | - | AAAACACTGAACCTCTGGGAGGG | | 1 | 4 | 63 SEQ ID NO. 1098 |
| (N20)NGG | X | 70330798 | - | CAAAACACTGAACCTCTGGGAGG | | 1 | 8 | 69 SEQ ID NO. 1099 |
| (N20)NGG | X | 70330801 | - | ACACAAAACACTGAACCTCTGGG | | 1 | 11 | 102 SEQ ID NO. 1100 |
| (N20)NGG | X | 70330802 | - | AACACAAAACACTGAACCTCTGG | | 1 | 4 | 92 SEQ ID NO. 1101 |
| (N20)NGG | X | 70330868 | - | AGAGTGAGGTTGGTAGGCTGGGG | | 1 | 6 | 61 SEQ ID NO. 1102 |
| (N20)NGG | X | 70330869 | - | CAGAGTGAGGTTGGTAGGCTGGG | | 2 | 2 | 33 SEQ ID NO. 1103 |
| (N20)NGG | X | 70330870 | - | GCAGAGTGAGGTTGGTAGGCTGG | | 1 | 5 | 37 SEQ ID NO. 1104 |
| (N20)NGG | X | 70330874 | - | TAATGCAGAGTGAGGTTGGTAGG | | 1 | 1 | 32 SEQ ID NO. 1105 |
| (N20)NGG | X | 70330878 | - | CCAATAATGCAGAGTGAGGTTGG | | 1 | 5 | 31 SEQ ID NO. 1106 |
| (N20)NGG | X | 70330882 | - | CATACCAATAATGCAGAGTGAGG | | 1 | 3 | 28 SEQ ID NO. 1107 |
| (N20)NGG | X | 70331331 | + | ATTTCTGCAGCTGCCCCTGCTGG | | 1 | 8 | 110 SEQ ID NO. 1108 |
| (N20)NGG | X | 70331332 | + | TTTCCTGCAGCTGCCCCTGCTGG | | 2 | 21 | 144 SEQ ID NO. 1109 |
| (N20)NGG | X | 70331337 | + | GCAGCTGCCCCTGCTGGGAGTGG | | 1 | 15 | 206 SEQ ID NO. 1110 |
| (N20)NGG | X | 70331338 | + | CAGCTGCCCCTGCTGGGAGTGGG | | 2 | 13 | 196 SEQ ID NO. 1111 |
| (N20)NGG | X | 70331339 | + | AGCTGCCCCTGCTGGGAGTGGGG | | 1 | 8 | 162 SEQ ID NO. 1112 |

FIG. 6 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | X | 70331368 | + | ACGACAATTCTGACGCCCAATGG | | 1 | 3 | SEQ ID NO. | 1113 |
| (N20)NGG | X | 70331369 | + | CGACAATTCTGACGCCCAATGGG | 1 | 1 | 5 | SEQ ID NO. | 1114 |
| (N20)NGG | X | 70331389 | + | GGGAATGAAGACACCACAGCTGG | 1 | 5 | 59 | SEQ ID NO. | 1115 |
| (N20)NGG | X | 70331392 | + | AATGAAGACACCACAGCTGGTGG | 3 | 9 | 74 | SEQ ID NO. | 1116 |
| (N20)NGG | X | 70331393 | + | ATGAAGACACCACAGCTGGTGGG | 1 | 7 | 54 | SEQ ID NO. | 1117 |
| (N20)NGG | X | 70331401 | + | ACCACAGCTGGTGGGAAATCTGG | 1 | 2 | 34 | SEQ ID NO. | 1118 |
| (N20)NGG | X | 70331402 | + | CCACAGCTGGTGGGAAATCTGGG | 1 | 6 | 105 | SEQ ID NO. | 1119 |
| (N20)NGG | X | 70331407 | + | GCTGGTGGGAAATCTGGGACTGG | 2 | 8 | 64 | SEQ ID NO. | 1120 |
| (N20)NGG | X | 70331410 | + | GGTGGGAAATCTGGGACTGGAGG | 1 | 4 | 96 | SEQ ID NO. | 1121 |
| (N20)NGG | X | 70331411 | + | GTGGGAAATCTGGGACTGGAGGG | 2 | 7 | 66 | SEQ ID NO. | 1122 |
| (N20)NGG | X | 70331412 | + | TGGGAAATCTGGGACTGGAGGGG | 1 | 8 | 95 | SEQ ID NO. | 1123 |
| (N20)NGG | X | 70331413 | + | GGGAAATCTGGGACTGGAGGGGG | 1 | 4 | 101 | SEQ ID NO. | 1124 |
| (N20)NGG | X | 70331250 | - | GCGCTTGCTCTTCTTCATTCCCTGG | 1 | 2 | 21 | SEQ ID NO. | 1125 |
| (N20)NGG | X | 70331251 | - | GGCGCTTGCTCTTCTTCATTCCCTGG | 1 | 1 | 23 | SEQ ID NO. | 1126 |
| (N20)NGG | X | 70331272 | - | TGGTAATGATGGCTTCAACATGG | 2 | 4 | 44 | SEQ ID NO. | 1127 |
| (N20)NGG | X | 70331283 | - | AGGGATGTGAATGGTAATGATGG | 1 | 5 | 65 | SEQ ID NO. | 1128 |
| (N20)NGG | X | 70331292 | - | AGGAATAAGAGGGATGTGAATGG | 1 | 11 | 130 | SEQ ID NO. | 1129 |
| (N20)NGG | X | 70331302 | - | GGGCAGCTGCAGGAATAAGAGGG | 1 | 4 | 71 | SEQ ID NO. | 1130 |
| (N20)NGG | X | 70331303 | - | GGGGCAGCTGCAGGAATAAGAGG | 1 | 4 | 82 | SEQ ID NO. | 1131 |
| (N20)NGG | X | 70331312 | - | CTCCCAGCAGGGGCAGCTGCAGG | 3 | 44 | 380 | SEQ ID NO. | 1132 |
| (N20)NGG | X | 70331322 | - | TTCAGCCCCACTCCCAGCAGGGG | 1 | 12 | 114 | SEQ ID NO. | 1133 |
| (N20)NGG | X | 70331323 | - | GTTCAGCCCCACTCCCAGCAGGG | 2 | 8 | 74 | SEQ ID NO. | 1134 |
| (N20)NGG | X | 70331324 | - | TGTTCAGCCCCACTCCCAGCAGG | 1 | 4 | 89 | SEQ ID NO. | 1135 |
| (N20)NGG | X | 70331361 | - | GTGGTGTCTTCATTCCCATTGGG | 1 | 8 | 113 | SEQ ID NO. | 1136 |
| (N20)NGG | X | 70331362 | - | TGTGGTGTCTTCATTCCCATTGG | 4 | 45 | 242 | SEQ ID NO. | 1137 |
| (N20)NGG | X | 70331380 | - | CCCAGATTTCCCACCAGCTGTGG | 1 | 7 | 101 | SEQ ID NO. | 1138 |

FIG. 6 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 5 | 35857092 | + | TCTCTCAGAATGACAATTCTAGG | 1 | 5 | 65 | SEQ ID NO. 1139 |
| (N20)NGG | 5 | 35857104 | + | ACAATTCTAGGTACAACTTTTGG | 1 | 1 | 53 | SEQ ID NO. 1140 |
| (N20)NGG | 5 | 35857109 | + | TCTAGGTACAACTTTTGGCATGG | 1 | 2 | 25 | SEQ ID NO. 1141 |
| (N20)NGG | 5 | 35857137 | + | TCTTTACTTCAAGTCGTTTCTGG | 1 | 3 | 24 | SEQ ID NO. 1142 |
| (N20)NGG | 5 | 35857146 | + | CAAGTCGTTTCTGGAGAAAGTGG | 1 | 3 | 41 | SEQ ID NO. 1143 |
| (N20)NGG | 5 | 35857161 | + | GAAAGTGGCTATGCTCAAAATGG | 1 | 3 | 49 | SEQ ID NO. 1144 |
| (N20)NGG | 5 | 35860953 | + | CTGCATGTTTGTTCCTCCCCAG | 1 | 5 | 138 | SEQ ID NO. 1145 |
| (N20)NGG | 5 | 35860961 | + | TTGTTCCTCCCCAGGAGACTTGG | 1 | 7 | 43 | SEQ ID NO. 1146 |
| (N20)NGG | 5 | 35860976 | + | AGACTTGGAAGATGCAGAACTGG | 1 | 4 | 89 | SEQ ID NO. 1147 |
| (N20)NGG | 5 | 35861009 | + | ATTCTCATGCTATAGCCAGTTGG | 1 | 3 | 24 | SEQ ID NO. 1148 |
| (N20)NGG | 5 | 35861019 | + | TATAGCCAGTTGGAAGTGAATGG | 1 | 1 | 44 | SEQ ID NO. 1149 |
| (N20)NGG | 5 | 35861051 | + | CTCACTGACCTGTGCTTTTGAGG | 1 | 4 | 45 | SEQ ID NO. 1150 |
| (N20)NGG | 5 | 35861078 | + | AGATGTCAACATCACCAATCTGG | 1 | 3 | 27 | SEQ ID NO. 1151 |
| (N20)NGG | 5 | 35861092 | + | CCAATCTGGAATTTGAAATATGG | 1 | 2 | 84 | SEQ ID NO. 1152 |
| (N20)NGG | 5 | 35861097 | + | CTGGAATTTGAAATATGGTGAGG | 1 | 6 | 67 | SEQ ID NO. 1153 |
| (N20)NGG | 5 | 35861098 | + | TGGAATTTGAAATATGGTGAGGG | 1 | 3 | 109 | SEQ ID NO. 1154 |
| (N20)NGG | 5 | 35861102 | + | ATTTGAAATATGGTGAGGGATGG | 1 | 4 | 107 | SEQ ID NO. 1155 |
| (N20)NGG | 5 | 35861105 | + | TGAAATATGGTGAGGGATGGTGG | 1 | 6 | 79 | SEQ ID NO. 1156 |
| (N20)NGG | 5 | 35861114 | - | GTGAGGGATGGTGGTTTTTAATGG | 1 | 2 | 47 | SEQ ID NO. 1157 |
| (N20)NGG | 5 | 35860944 | - | ATCTTCCAAGTCTCCTGGGGAGG | 2 | 3 | 42 | SEQ ID NO. 1158 |
| (N20)NGG | 5 | 35860947 | - | TGCATCTTCCAAGTCTCCTGGGG | 1 | 7 | 71 | SEQ ID NO. 1159 |
| (N20)NGG | 5 | 35860948 | - | CTGCATCTTCCAAGTCTCCTGGG | 1 | 6 | 70 | SEQ ID NO. 1160 |
| (N20)NGG | 5 | 35860949 | - | TCTGCATCTTCCAAGTCTCCTGG | 1 | 5 | 86 | SEQ ID NO. 1161 |
| (N20)NGG | 5 | 35861002 | - | GCGATCCATTCACTTCCAACTGG | 1 | 8 | 82 | SEQ ID NO. 1162 |
| (N20)NGG | 5 | 35861037 | - | ATCTGGGTCCTCAAAAGCACAGG | 1 | 4 | 34 | SEQ ID NO. 1163 |
| (N20)NGG | 5 | 35861053 | - | GATTGGTGATGTTGACATCTGGG | 1 | 2 | 36 | SEQ ID NO. 1164 |
| (N20)NGG | 5 | 35861054 | - | AGATTGGTGATGTTGACATCTGG | 1 | 3 | 28 | SEQ ID NO. 1165 |
| (N20)NGG | 5 | 35861070 | - | CCATATTCAAATTCCAGATTGG | 1 | 4 | 91 | SEQ ID NO. 1166 |
| (N20)NGG | 5 | 35867409 | + | TCCCCTTTTTATTCCTACAGTGG | 1 | 3 | 68 | SEQ ID NO. 1167 |
| (N20)NGG | 5 | 35867410 | + | CCCCTTTTTATTCCTACAGTGGG | 1 | 5 | 52 | SEQ ID NO. 1168 |
| (N20)NGG | 5 | 35867411 | + | CCCTTTTTATTCCTACAGTGGGG | 1 | 9 | 56 | SEQ ID NO. 1169 |
| (N20)NGG | 5 | 35867420 | + | TTCCTACAGTGGGGCCCTCGTGG | 1 | 1 | 11 | SEQ ID NO. 1170 |
| (N20)NGG | 5 | 35867423 | + | CTACAGTGGGGCCCTCGTGGAGG | 1 | 3 | 22 | SEQ ID NO. 1171 |
| (N20)NGG | 5 | 35867443 | + | AGGTAAAGTGCCTGAATTTCAGG | 1 | 3 | 47 | SEQ ID NO. 1172 |

FIG. 7

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 5 | 35867493 | + | ACAAAGAAATTCTTACTGATTGG | 1 | 4 | 81 | SEQ ID NO. 1173 |
| (N20)NGG | 5 | 35867516 | + | AAAGAGCAATATATGTGTGAAGG | 2 | 9 | 100 | SEQ ID NO. 1174 |
| (N20)NGG | 5 | 35867520 | + | AGCAATATATGTGTGAAGGTTGG | 2 | 2 | 37 | SEQ ID NO. 1175 |
| (N20)NGG | 5 | 35867565 | + | AAAATAGACCTAACCACTATAGG | 1 | 3 | 38 | SEQ ID NO. 1176 |
| (N20)NGG | 5 | 35867388 | - | CCCACTGTAGGAATAAAAAGGGG | 1 | 2 | 57 | SEQ ID NO. 1177 |
| (N20)NGG | 5 | 35867389 | - | CCCCACTGTAGGAATAAAAAGGG | 1 | 5 | 66 | SEQ ID NO. 1178 |
| (N20)NGG | 5 | 35867390 | - | GCCCCACTGTAGGAATAAAAAGG | 1 | 5 | 43 | SEQ ID NO. 1179 |
| (N20)NGG | 5 | 35867400 | - | CTCCACGAGGGCCCCACTGTAGG | 1 | 1 | 30 | SEQ ID NO. 1180 |
| (N20)NGG | 5 | 35867412 | - | CAGGCACTTTACCTCCACGAGGG | 1 | 1 | 17 | SEQ ID NO. 1181 |
| (N20)NGG | 5 | 35867413 | - | TCAGGCACTTTACCTCCACGAGG | 1 | 2 | 20 | SEQ ID NO. 1182 |
| (N20)NGG | 5 | 35867431 | - | CTTGTAGTTTCCTGAAATTCAGG | 1 | 1 | 70 | SEQ ID NO. 1183 |
| (N20)NGG | 5 | 35867535 | - | GGTTAGGTCTATTTTTTCGAGG | 1 | 1 | 35 | SEQ ID NO. 1184 |
| (N20)NGG | 5 | 35867551 | - | ACTTCTTACCTATAGTGGTTAGG | 1 | 1 | 33 | SEQ ID NO. 1185 |
| (N20)NGG | 5 | 35867556 | - | ATACAACTTCTTACCTATAGTGG | 2 | 3 | 57 | SEQ ID NO. 1186 |
| (N20)NGG | 5 | 35871168 | + | TTCTTTTCCAGTTAAACCTGAGG | 1 | 6 | 90 | SEQ ID NO. 1187 |
| (N20)NGG | 5 | 35871197 | + | TTGACCTGAGTGTCGTCTATCGG | 1 | 3 | 13 | SEQ ID NO. 1188 |
| (N20)NGG | 5 | 35871198 | + | TGACCTGAGTGTCGTCTATCGGG | 1 | 4 | 13 | SEQ ID NO. 1189 |
| (N20)NGG | 5 | 35871202 | + | CTGAGTGTCGTCTATCGGAAGG | 1 | 1 | 3 | SEQ ID NO. 1190 |
| (N20)NGG | 5 | 35871219 | + | GGAAGGAGCCAATGACTTTGTGG | 1 | 3 | 70 | SEQ ID NO. 1191 |
| (N20)NGG | 5 | 35871291 | + | GCACGATGTAGCTTACCGCCAGG | 1 | 1 | 1 | SEQ ID NO. 1192 |
| (N20)NGG | 5 | 35871297 | + | TGTAGCTTACCGCCAGGAAAAGG | 1 | 2 | 11 | SEQ ID NO. 1193 |
| (N20)NGG | 5 | 35871311 | + | AGGAAAAGGATGAAAACAAATGG | 2 | 48 | 722 | SEQ ID NO. 1194 |
| (N20)NGG | 5 | 35871315 | + | AAAGGATGAAAACAAATGACGG | 3 | 70 | 1031 | SEQ ID NO. 1195 |
| (N20)NGG | 5 | 35871153 | - | AAAGGAGCCTCCAGGTTTAACTGG | 1 | 3 | 24 | SEQ ID NO. 1196 |
| (N20)NGG | 5 | 35871162 | - | CTCAGGTCAAAAGGAGCCTCAGG | 1 | 2 | 45 | SEQ ID NO. 1197 |
| (N20)NGG | 5 | 35871171 | - | TAGACGACACTCAGGTCAAAAGG | 1 | 3 | 13 | SEQ ID NO. 1198 |
| (N20)NGG | 5 | 35871179 | - | CTTCCCGATAGACGACACTCAGG | 2 | 10 | 217 | SEQ ID NO. 1199 |
| (N20)NGG | 5 | 35871205 | - | AAATGTCACCACAAAGTCATTGG | 1 | 5 | 2 | SEQ ID NO. 1200 |
| (N20)NGG | 5 | 35871284 | - | TGTTTTCATCCTTTTCCTGGCGG | 1 | 3 | 80 | SEQ ID NO. 1201 |
| (N20)NGG | 5 | 35871287 | - | ATTTGTTTTCATCCTTTTCCTGG | 1 | 10 | 151 | SEQ ID NO. 1202 |
| (N20)NGG | 5 | 35873635 | + | CCTGCAGAGAAAGCTCCAACCGG | 1 | 10 | 217 | SEQ ID NO. 1203 |
| (N20)NGG | 5 | 35873687 | + | ATCCCTGATCACTATTTTAAAGG | 1 | 5 | 50 | SEQ ID NO. 1204 |
| (N20)NGG | 5 | 35873694 | + | ATCACTATTTTAAAGGCTTCTGG | 2 | 3 | 48 | SEQ ID NO. 1205 |
| (N20)NGG | 5 | 35873703 | + | TTAAAGGCTTCTGGAGTGAATGG | 1 | 6 | 109 | SEQ ID NO. 1206 |

FIG. 7 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 5 | 35873750 | + | CCAGAGATCAATAATAGCTCAGG | 1 | 3 | 26 | SEQ ID NO. 1207 |
| (N20)NGG | 5 | 35873755 | + | GATCAATAATAGCTCAGGTAAGG | 1 | 2 | 20 | SEQ ID NO. 1208 |
| (N20)NGG | 5 | 35873760 | + | ATAATAGCTCAGGTAAGGAATGG | 1 | 9 | 58 | SEQ ID NO. 1209 |
| (N20)NGG | 5 | 35873763 | + | ATAGCTCAGGTAAGGAATGGTGG | 1 | 2 | 47 | SEQ ID NO. 1210 |
| (N20)NGG | 5 | 35873594 | - | CAGGAGTGTCAGCTTTGTGCTGG | 1 | 8 | 52 | SEQ ID NO. 1211 |
| (N20)NGG | 5 | 35873613 | - | CCGGTTGGAGCTTTCTCTGCAGG | 1 | 1 | 17 | SEQ ID NO. 1212 |
| (N20)NGG | 5 | 35873628 | - | TCTCATACATTGCTGCCGGTTGG | 1 | 5 | 57 | SEQ ID NO. 1213 |
| (N20)NGG | 5 | 35873632 | - | TTAATCTCATACATTGCTGCCGG | 1 | 9 | 114 | SEQ ID NO. 1214 |
| (N20)NGG | 5 | 35873663 | - | TTTAAAATAGTGATCAGGGATGG | 2 | 9 | 131 | SEQ ID NO. 1215 |
| (N20)NGG | 5 | 35873667 | - | AGCCTTTAAAATAGTGATCAGGG | 1 | 11 | 135 | SEQ ID NO. 1216 |
| (N20)NGG | 5 | 35873668 | - | AAGCCTTTAAAATAGTGATCAGG | 1 | 6 | 66 | SEQ ID NO. 1217 |
| (N20)NGG | 5 | 35873707 | - | GGAGTTCTGAAGTAATAACTTGG | 1 | 4 | 31 | SEQ ID NO. 1218 |
| (N20)NGG | 5 | 35873728 | - | CCTGAGCTATTATTGATCTCTGG | 1 | 1 | 25 | SEQ ID NO. 1219 |
| (N20)NGG | 5 | 35874550 | + | ACAATCTATTCTTGCTTTCCAGG | 1 | 10 | 59 | SEQ ID NO. 1220 |
| (N20)NGG | 5 | 35874551 | + | CAATCTATTCTTGCTTTCCAGGG | 1 | 8 | 70 | SEQ ID NO. 1221 |
| (N20)NGG | 5 | 35874552 | + | AATCTATTCTTGCTTTCCAGGGG | 2 | 7 | 77 | SEQ ID NO. 1222 |
| (N20)NGG | 5 | 35874558 | + | TTCTTGCTTTCCAGGGAGAGATGG | 1 | 11 | 89 | SEQ ID NO. 1223 |
| (N20)NGG | 5 | 35874612 | + | TTTTTTCTCTGCGCTCTGTTGG | 1 | 9 | 192 | SEQ ID NO. 1224 |
| (N20)NGG | 5 | 35874621 | + | TGTCGCTCTGTTGGTCATCTTGG | 1 | 1 | 26 | SEQ ID NO. 1225 |
| (N20)NGG | 5 | 35874635 | + | TCATCTTGGCCTGTGTGTTATGG | 1 | 4 | 46 | SEQ ID NO. 1226 |
| (N20)NGG | 5 | 35874644 | + | CCTGTGTTATGGAAAAAAAGG | 1 | 7 | 98 | SEQ ID NO. 1227 |
| (N20)NGG | 5 | 35874526 | - | TGGAAAGCAAGAATAGATTGTGG | 2 | 5 | 129 | SEQ ID NO. 1228 |
| (N20)NGG | 5 | 35874546 | - | AAGATAGGATCCATCTCCCCTGG | 1 | 3 | 27 | SEQ ID NO. 1229 |
| (N20)NGG | 5 | 35874561 | - | ATGCTGATGGTTAGTAAGATAGG | 1 | 2 | 30 | SEQ ID NO. 1230 |
| (N20)NGG | 5 | 35874574 | - | GAAAAAACTCAAAATGCTGATGG | 1 | 14 | 200 | SEQ ID NO. 1231 |
| (N20)NGG | 5 | 35874622 | - | CCTTTTTTCCATAACACACAGG | 1 | 1 | 75 | SEQ ID NO. 1232 |
| (N20)NGG | 5 | 35875613 | + | TATCAATGTTCTCTGATTTCAGG | 1 | 12 | 84 | SEQ ID NO. 1233 |
| (N20)NGG | 5 | 35875631 | + | TCAGGATTAAGCCTATCGTATGG | 1 | 1 | 5 | SEQ ID NO. 1234 |
| (N20)NGG | 5 | 35875662 | + | CCCCGATCATAAGAAGACTTCGG | 1 | 1 | 6 | SEQ ID NO. 1235 |
| (N20)NGG | 5 | 35875702 | + | CCAAGAAAGTGAGTGTTTTTGG | 1 | 17 | 122 | SEQ ID NO. 1236 |
| (N20)NGG | 5 | 35875620 | - | GGGAGACTGGCCATACGATAGG | 1 | 1 | 6 | SEQ ID NO. 1237 |
| (N20)NGG | 5 | 35875632 | - | TTCTTATGATCGGGAGGACTGG | 1 | 2 | 26 | SEQ ID NO. 1238 |
| (N20)NGG | 5 | 35875633 | - | CTTCTTATGATCGGGAGACTGG | 1 | 1 | 11 | SEQ ID NO. 1239 |
| (N20)NGG | 5 | 35875640 | - | CCAGAGTCTTCTTATGATCGGGG | 1 | 1 | 12 | SEQ ID NO. 1240 |

FIG. 7 cont.

| site_type | site_chr omosome | site_start_ nucleotide | site_st rand | target_site_sequence_with_NGG | genome_wide_ hits_with_1 or_less_mism atches | genome_wide_ hits_with_2 or_less_mism atches | genome_wide_h its_with_3_or _less_mismatc hes | | |
|---|---|---|---|---|---|---|---|---|---|
| (N20)NGG | 5 | 35875641 | - | TCCAGAGTCTCTTATGATCGGG | 1 | 2 | 27 | SEQ ID NO. | 1241 |
| (N20)NGG | 5 | 35875642 | - | TTCCAGAGTCTCTTATGATCGG | 1 | 5 | 82 | SEQ ID NO. | 1242 |
| (N20)NGG | 5 | 35875680 | - | CCAAAAACACTCACTTTTCTTGG | 1 | 5 | 106 | SEQ ID NO. | 1243 |
| (N20)NGG | 5 | 35876120 | + | TTTCAATCCTGAAAGTTTCCTGG | 1 | 7 | 96 | SEQ ID NO. | 1244 |
| (N20)NGG | 5 | 35876137 | + | TCCTGGACTGCCAGATTCATAGG | 1 | 1 | 37 | SEQ ID NO. | 1245 |
| (N20)NGG | 5 | 35876138 | + | CCTGGACTGCCAGATTCATAGGG | 1 | 2 | 39 | SEQ ID NO. | 1246 |
| (N20)NGG | 5 | 35876141 | + | GGACTGCCAGATTCATAGGGTGG | 1 | 1 | 22 | SEQ ID NO. | 1247 |
| (N20)NGG | 5 | 35876168 | + | CATTCAAGCTAGAGATGAAGTGG | 1 | 2 | 50 | SEQ ID NO. | 1248 |
| (N20)NGG | 5 | 35876172 | + | CAAGCTAGAGATGAAGTGAAGG | 2 | 4 | 66 | SEQ ID NO. | 1249 |
| (N20)NGG | 5 | 35876224 | + | TAGAAGAATCTGAGAAGCAGAGG | 3 | 17 | 163 | SEQ ID NO. | 1250 |
| (N20)NGG | 5 | 35876229 | + | GAATCTGAGAAGCAGAGGCTTGG | 1 | 12 | 241 | SEQ ID NO. | 1251 |
| (N20)NGG | 5 | 35876232 | + | TCTGAGAAGCAGAGGCTTGGAGG | 2 | 9 | 193 | SEQ ID NO. | 1252 |
| (N20)NGG | 5 | 35876233 | + | CTGAGAAGCAGAGGCTTGGAGGG | 1 | 17 | 261 | SEQ ID NO. | 1253 |
| (N20)NGG | 5 | 35876234 | + | TGAGAAGCAGAGGCTTGGAGGGG | 5 | 27 | | SEQ ID NO. | 1254 |
| (N20)NGG | 5 | 35876264 | + | GAGCCCAACTCCCCATCTGACG | 1 | 6 | 53 | SEQ ID NO. | 1255 |
| (N20)NGG | 5 | 35876292 | + | GTCATCACTCCAGAAAGCTTTGG | 1 | 2 | 35 | SEQ ID NO. | 1256 |
| (N20)NGG | 5 | 35876318 | + | AGATTCATCCCTCACATGCCTGG | 1 | 1 | 43 | SEQ ID NO. | 1257 |
| (N20)NGG | 5 | 35876322 | + | TCATCCCTCACATGCCTGGCTGG | 1 | 4 | 69 | SEQ ID NO. | 1258 |
| (N20)NGG | 5 | 35876323 | + | CATCCCTCACATGCCTGGCTGGG | 1 | 5 | 91 | SEQ ID NO. | 1259 |
| (N20)NGG | 5 | 35876365 | + | CCCCTATTCTCTCTCTTCCAGG | 3 | 15 | 178 | SEQ ID NO. | 1260 |
| (N20)NGG | 5 | 35876380 | + | CTTCCAGGTCCCTAGACTGCAGG | 1 | 3 | 69 | SEQ ID NO. | 1261 |
| (N20)NGG | 5 | 35876381 | + | TTCCAGGTCCCTAGACTGCAGGG | 1 | 8 | 143 | SEQ ID NO. | 1262 |
| (N20)NGG | 5 | 35876388 | + | TCCCTAGACTGCAGGGAGAGTGG | 1 | 3 | 75 | SEQ ID NO. | 1263 |
| (N20)NGG | 5 | 35876397 | + | TGCAGGGAGAGTGCCAAGAATGG | 2 | 13 | 157 | SEQ ID NO. | 1264 |
| (N20)NGG | 5 | 35876398 | + | GCAGGGAGAGTGCCAAGAATGGG | 2 | 7 | 94 | SEQ ID NO. | 1265 |
| (N20)NGG | 5 | 35876414 | + | GAATGGGCCTCATGTGTACCAGG | 1 | 2 | 18 | SEQ ID NO. | 1266 |
| (N20)NGG | 5 | 35876433 | + | CAGGACCTCCTGCTTAGCCTTGG | 2 | 37 | 129 | SEQ ID NO. | 1267 |
| (N20)NGG | 5 | 35876434 | + | AGGACCTCCTGCTTAGCCTTGGG | 2 | 4 | 43 | SEQ ID NO. | 1268 |
| (N20)NGG | 5 | 35876478 | + | CCTCCATTTTCTCTCCAATCTGG | 1 | 7 | 95 | SEQ ID NO. | 1269 |
| (N20)NGG | 5 | 35876507 | + | GACATTGAACCCAGTTGCTCAGG | 1 | 6 | 37 | SEQ ID NO. | 1270 |
| (N20)NGG | 5 | 35876508 | + | ACATTGAACCCAGTTGCTCAGGG | 1 | 4 | 49 | SEQ ID NO. | 1271 |
| (N20)NGG | 5 | 35876531 | + | TCAGCCCATTCTTACTTCCCTGG | 1 | 5 | 54 | SEQ ID NO. | 1272 |
| (N20)NGG | 5 | 35876532 | + | CAGCCCATTCTTACTTCCCTGGG | 1 | 2 | 59 | SEQ ID NO. | 1273 |
| (N20)NGG | 5 | 35876061 | - | CTGCACAGAAAAAGGAGAAAGG | 2 | 26 | 307 | SEQ ID NO. | 1274 |

FIG. 7 cont.

| site_type | site_chr omosome | site_start_ nucleotide | site_st rand | target_site_sequence_wit h_NGG | genome_wide_ hits_with_1_ or_less_mism atches | genome_wide_ hits_with_2_ or_less_mism atches | genome_wide_h its_with_3_or _less_mismatc hes | | |
|---|---|---|---|---|---|---|---|---|---|
| (N20)NGG | 5 | 35876062 | - | TCTGCACAGAAAAGGAGAAAGG | 2 | 15 | 207 | SEQ ID NO. | 1275 |
| (N20)NGG | 5 | 35876069 | - | TTTAAATTCTGCACAGAAAAGG | 2 | 22 | 385 | SEQ ID NO. | 1276 |
| (N20)NGG | 5 | 35876105 | - | TGGCAGTCCAGGAAACTTTCAGG | 1 | 3 | 25 | SEQ ID NO. | 1277 |
| (N20)NGG | 5 | 35876116 | - | CCCTATGAATCTGGCAGTCCAGG | 1 | 2 | 39 | SEQ ID NO. | 1278 |
| (N20)NGG | 5 | 35876125 | - | TGTCATCCACCCTATGAATCTGG | 1 | 2 | 8 | SEQ ID NO. | 1279 |
| (N20)NGG | 5 | 35876192 | - | TCAGATTCTTCTAGTTGCTGAGG | 1 | 4 | 66 | SEQ ID NO. | 1280 |
| (N20)NGG | 5 | 35876245 | - | CATCCTCAGATGGGCAGTTGGG | 1 | 2 | 52 | SEQ ID NO. | 1281 |
| (N20)NGG | 5 | 35876246 | - | ACATCCTCAGATGGGCAGTTGG | 1 | 2 | 33 | SEQ ID NO. | 1282 |
| (N20)NGG | 5 | 35876247 | - | TACATCCTCAGATGGGCAGTTGG | 1 | 2 | 36 | SEQ ID NO. | 1283 |
| (N20)NGG | 5 | 35876254 | - | TGATGACTACATCCTCAGATGGG | 1 | 3 | 25 | SEQ ID NO. | 1284 |
| (N20)NGG | 5 | 35876255 | - | GTGATGACTACATCCTCAGATGG | 2 | 3 | 23 | SEQ ID NO. | 1285 |
| (N20)NGG | 5 | 35876279 | - | GAATCTCTTCCAAAGCTTTCTGG | 2 | 9 | 69 | SEQ ID NO. | 1286 |
| (N20)NGG | 5 | 35876304 | - | ATTCCCAGCCAGGCATGTGAGG | 1 | 6 | 54 | SEQ ID NO. | 1287 |
| (N20)NGG | 5 | 35876305 | - | CATTCCCAGCCAGGCATGTGAGG | 1 | 9 | 61 | SEQ ID NO. | 1288 |
| (N20)NGG | 5 | 35876314 | - | ATGCACTGACATTCCCAGCCAGG | 1 | 4 | 42 | SEQ ID NO. | 1289 |
| (N20)NGG | 5 | 35876343 | - | CCTGGAAGAGGAGAATAGGGG | 2 | 10 | 144 | SEQ ID NO. | 1290 |
| (N20)NGG | 5 | 35876344 | - | ACCTGGAAGAGGAGAGAATAGG | 1 | 7 | 142 | SEQ ID NO. | 1291 |
| (N20)NGG | 5 | 35876345 | - | GACCTGGAAGAGGAGAGAATAGG | 1 | 7 | 150 | SEQ ID NO. | 1292 |
| (N20)NGG | 5 | 35876355 | - | GCAGTCTAGGGACCTGGAAGAGG | 1 | 5 | 109 | SEQ ID NO. | 1293 |
| (N20)NGG | 5 | 35876361 | - | CTCCCTGCAGTCTAGGGACCTGG | 1 | 2 | 69 | SEQ ID NO. | 1294 |
| (N20)NGG | 5 | 35876367 | - | GCCACTCTCCCTGCAGTCTAGG | 1 | 2 | 38 | SEQ ID NO. | 1295 |
| (N20)NGG | 5 | 35876368 | - | TGCCACTCTCCCTGCAGTCTAGG | 1 | 4 | 71 | SEQ ID NO. | 1296 |
| (N20)NGG | 5 | 35876399 | - | AGGAGGTCCTGGTACACATGAGG | 1 | 2 | 43 | SEQ ID NO. | 1297 |
| (N20)NGG | 5 | 35876410 | - | CAAGGCTAAGCAGGAGGTCCTGG | 1 | 2 | 28 | SEQ ID NO. | 1298 |
| (N20)NGG | 5 | 35876416 | - | TAGTCCCAAGGCTAAGCAGGAGG | 1 | 3 | 35 | SEQ ID NO. | 1299 |
| (N20)NGG | 5 | 35876419 | - | TTGTAGTCCCAAGGCTAAGCAGG | 1 | 1 | 21 | SEQ ID NO. | 1300 |
| (N20)NGG | 5 | 35876428 | - | GCGTGCTGTTTGTAGTCCCAAGG | 1 | 1 | 9 | SEQ ID NO. | 1301 |
| (N20)NGG | 5 | 35876453 | - | GATTGGAGAGAAAATGCAGGGGG | 1 | 19 | 192 | SEQ ID NO. | 1302 |
| (N20)NGG | 5 | 35876454 | - | AGATTGGAGAGAAAATGGAGGGG | 2 | 24 | 394 | SEQ ID NO. | 1303 |
| (N20)NGG | 5 | 35876455 | - | CAGATTGGAGAGAAAATGGAGGG | 4 | 13 | 191 | SEQ ID NO. | 1304 |
| (N20)NGG | 5 | 35876456 | - | CCAGATTGGAGAGAAAATGGAGG | 1 | 6 | 115 | SEQ ID NO. | 1305 |
| (N20)NGG | 5 | 35876459 | - | ATTCCAGATTGGAGAGAAAATGG | 2 | 11 | 145 | SEQ ID NO. | 1306 |
| (N20)NGG | 5 | 35876470 | - | TCAATGTCAGGATTCCAGATTGG | 1 | 4 | 39 | SEQ ID NO. | 1307 |
| (N20)NGG | 5 | 35876482 | - | GAGCAACTGGGTTCAATGTCAGG | 1 | 3 | 20 | SEQ ID NO. | 1308 |

FIG. 7 cont.

| site type | site_chr omosome | site_start nucleotide | site_st rand | target_site_sequence_with_NGG | genome_wide_ hits_with_1_ or_less_mism atches | genome_wide_ hits_with_2_ or_less_mism atches | genome_wide_h its_with_3_or _less_mismatc hes | |
|---|---|---|---|---|---|---|---|---|
| (N20)NGG | 5 | 35876494 | - | TGGGCTGACCCTGAGCAACTGGG | 1 | | 4 | 36 SEQ ID NO. 1309 |
| (N20)NGG | 5 | 35876495 | - | ATGGGCTGACCCTGAGCAACTCGG | 1 | | 3 | 39 SEQ ID NO. 1310 |
| (N20)NGG | 5 | 35876513 | - | GATCCCAGGGAAGTAAGAATGGG | 1 | | 7 | 81 SEQ ID NO. 1311 |
| (N20)NGG | 5 | 35876514 | - | TGATCCCAGGGAAGTAAGAATGG | 1 | | 18 | 211 SEQ ID NO. 1312 |
| (N20)NGG | 5 | 35876526 | - | TTCTTCTTGATTTGATCCCAGGG | 1 | | 2 | 82 SEQ ID NO. 1313 |
| (N20)NGG | 5 | 35876527 | - | CTTCTTCTTGATTTGATCCCAGG | 1 | | 7 | 173 SEQ ID NO. 1314 |
| (N20)NGG | 5 | 35876559 | - | GTTTTGGTAGAAGCTGGACATGG | 1 | | 5 | 131 SEQ ID NO. 1315 |
| (N20)NGG | 5 | 35876565 | - | TCACTGGTTTTGGTAGAAGCTGG | 1 | | 5 | 53 SEQ ID NO. 1316 |
| (N20)NGG | 5 | 35876575 | - | TTCTTACACTTCACTGGTTTTGG | 1 | | 7 | 62 SEQ ID NO. 1317 |
| (N20)NGG | 5 | 35876581 | - | CTGGGTTTCTTACACTTCACTGG | 1 | | 1 | 37 SEQ ID NO. 1318 |

FIG. 7 cont.

| site_type | site_chr omosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17937551 | + | TTATCTGTCCCCGCCCCTCAGG | 1 | 2 | 35 | SEQ ID NO. 1319 |
| (N20)NGG | 19 | 17937577 | + | ACAGCTCATGAAGCTGTGCTGG | 1 | 3 | 13 | SEQ ID NO. 1320 |
| (N20)NGG | 19 | 17937578 | + | CAGCTCATGAAGCTGTGCTGGG | 1 | 3 | 18 | SEQ ID NO. 1321 |
| (N20)NGG | 19 | 17937593 | + | GTGCTGGGCCCCTAGCCCACAGG | 1 | 5 | 61 | SEQ ID NO. 1322 |
| (N20)NGG | 19 | 17937598 | + | GGGCCCCTAGCCCACAGGACCGG | 1 | 4 | 83 | SEQ ID NO. 1323 |
| (N20)NGG | 19 | 17937617 | + | CCGGCCATCATTCAGCGCCCTGG | 1 | 1 | 7 | SEQ ID NO. 1324 |
| (N20)NGG | 19 | 17937618 | + | CGGCCATCATTCAGCGCCCTGGG | 1 | 2 | 3 | SEQ ID NO. 1325 |
| (N20)NGG | 19 | 17937629 | + | CAGCGCCCTGGGCCCCCAGCTGG | 1 | 9 | 113 | SEQ ID NO. 1326 |
| (N20)NGG | 19 | 17937640 | + | GCCCCAGCTGGACATGCTGTGG | 1 | 3 | 74 | SEQ ID NO. 1327 |
| (N20)NGG | 19 | 17937645 | + | CAGCTGGACATGCTGTGAGCGG | 1 | 8 | 69 | SEQ ID NO. 1328 |
| (N20)NGG | 19 | 17937652 | + | ACATGCTGTGAGCGGAAGCCGG | 1 | 1 | 25 | SEQ ID NO. 1329 |
| (N20)NGG | 19 | 17937653 | + | CATGCTGTGAGCGGAAGCCGGG | 1 | 5 | 28 | SEQ ID NO. 1330 |
| (N20)NGG | 19 | 17937654 | + | ATGCTGTGAGCGGAAGCCGGGG | 1 | 2 | 18 | SEQ ID NO. 1331 |
| (N20)NGG | 19 | 17937655 | + | TGCTGTGGAGCGGAAGCCGGGGG | 1 | 1 | 21 | SEQ ID NO. 1332 |
| (N20)NGG | 19 | 17937689 | + | TGCCTTCACTGCTCACCCAGAGG | 1 | 2 | 60 | SEQ ID NO. 1333 |
| (N20)NGG | 19 | 17937690 | + | GCCTTCACTGCTCACCCAGAGGG | 1 | 7 | 51 | SEQ ID NO. 1334 |
| (N20)NGG | 19 | 17937739 | + | AGCTCCTGCCCGACAGACCTCTGG | 1 | 6 | 64 | SEQ ID NO. 1335 |
| (N20)NGG | 19 | 17937526 | - | GAGGGGCGGGGACAGATAATGG | 1 | 8 | 99 | SEQ ID NO. 1336 |
| (N20)NGG | 19 | 17937537 | - | CTCGTGAACCTGAGGGGCGGGG | 1 | 63 | 1843 | SEQ ID NO. 1337 |
| (N20)NGG | 19 | 17937538 | - | GCTCGTGAACCTGAGGGGCGGG | 1 | 5 | 100 | SEQ ID NO. 1338 |
| (N20)NGG | 19 | 17937539 | - | AGCTCGTGAACCTGAGGGGCGG | 1 | 3 | 36 | SEQ ID NO. 1339 |
| (N20)NGG | 19 | 17937540 | - | GAGCTCGTGAACCTGAGGGGGCGG | 1 | 1 | 22 | SEQ ID NO. 1340 |
| (N20)NGG | 19 | 17937543 | - | CATGAGCTCGTGAACCTGAGGGG | 1 | 1 | 9 | SEQ ID NO. 1341 |
| (N20)NGG | 19 | 17937544 | - | TCATGAGCTCGTGAACCTGAGG | 1 | 1 | 13 | SEQ ID NO. 1342 |
| (N20)NGG | 19 | 17937545 | - | TTCATGAGCTCGTGAACCTGAGG | 1 | 3 | 19 | SEQ ID NO. 1343 |
| (N20)NGG | 19 | 17937579 | - | TGGCCGTCCTGTGGGCTAGGGG | 1 | 5 | 18 | SEQ ID NO. 1344 |
| (N20)NGG | 19 | 17937580 | - | ATGGCCGTCCTGTGGGCTAGG | 1 | 1 | 14 | SEQ ID NO. 1345 |
| (N20)NGG | 19 | 17937581 | - | GATGGCCGGTCCTGTGGGCTAGG | 1 | 1 | 22 | SEQ ID NO. 1346 |
| (N20)NGG | 19 | 17937586 | - | TGAATGATGGCCGGTCCTGTGG | 1 | 7 | 93 | SEQ ID NO. 1347 |
| (N20)NGG | 19 | 17937587 | - | CTGAATGATGGCCGGTCCTGTGG | 1 | 2 | 16 | SEQ ID NO. 1348 |
| (N20)NGG | 19 | 17937595 | - | CCAGGGCGCTGAATCATGGCCGG | 1 | 1 | 12 | SEQ ID NO. 1349 |
| (N20)NGG | 19 | 17937599 | - | GGGCCCAGGGCGCTGAATGATGG | 1 | 3 | 33 | SEQ ID NO. 1350 |
| (N20)NGG | 19 | 17937612 | - | CATGTCCAGCTGGGGGCCCAGGG | 1 | 7 | 59 | SEQ ID NO. 1351 |

FIG. 8

| site type | site_chr omosome | site_start_ nucleotide | site_s trand | target_site_sequence_with_NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 19 | 17937613 | - | GCATGTCCAGCTGGGGGCCAGG | | 1 | 6 | 70 SEQ ID NO. 1352 |
| (N20)NGG | 19 | 17937619 | - | TCCACAGCATGTCCAGCTGGGG | | 1 | 5 | 67 SEQ ID NO. 1353 |
| (N20)NGG | 19 | 17937620 | - | CTCCACAGCATGTCCAGCTGGG | | 1 | 2 | 71 SEQ ID NO. 1354 |
| (N20)NGG | 19 | 17937621 | - | GCTCCACAGCATGTCCAGCTGG | | 1 | 3 | 37 SEQ ID NO. 1355 |
| (N20)NGG | 19 | 17937622 | - | CGCTCCACAGCATGTCCAGCTGG | | 1 | 2 | 28 SEQ ID NO. 1356 |
| (N20)NGG | 19 | 17937649 | - | AGGCATGAGTCTCACACCCCGG | | 1 | 5 | 38 SEQ ID NO. 1357 |
| (N20)NGG | 19 | 17937669 | - | GCCCTCTGGGTGAGCAGTGAAGG | | 1 | 4 | 62 SEQ ID NO. 1358 |
| (N20)NGG | 19 | 17937682 | - | GGGAGTGGTGTGTTTGCCCTCTGG | | 1 | 2 | 42 SEQ ID NO. 1359 |
| (N20)NGG | 19 | 17937683 | - | AGGGAGTGGTGTTTGCCCTCTGG | | 1 | 4 | 49 SEQ ID NO. 1360 |
| (N20)NGG | 19 | 17937697 | - | GCTATGAAAAGACAGGGAGTGG | | 1 | 6 | 89 SEQ ID NO. 1361 |
| (N20)NGG | 19 | 17937702 | - | CAGGAGCTATGAAAAGGACAGG | | 2 | 6 | 79 SEQ ID NO. 1362 |
| (N20)NGG | 19 | 17937703 | - | GCAGGAGCTATGAAAAGGACAGG | | 1 | 4 | 47 SEQ ID NO. 1363 |
| (N20)NGG | 19 | 17937708 | - | TGCGGGCAGGAGCTATGAAAAGG | | 1 | 4 | 28 SEQ ID NO. 1364 |
| (N20)NGG | 19 | 17937721 | - | TAATCCAGAGGTCTGCGGGCAGG | | 1 | 1 | 21 SEQ ID NO. 1365 |
| (N20)NGG | 19 | 17940916 | + | ATGCGCTCCCTCCTTGGCTCCAGG | | 1 | 6 | 33 SEQ ID NO. 1366 |
| (N20)NGG | 19 | 17940927 | + | CTTGGCTCCAGGAGTTCCTGCGG | | 1 | 9 | 84 SEQ ID NO. 1367 |
| (N20)NGG | 19 | 17940934 | + | CCAGGAGTTCCTGCGGATGATGG | | 1 | 3 | 27 SEQ ID NO. 1368 |
| (N20)NGG | 19 | 17940935 | + | CAGGAGTTCCTGCGGATGATGGG | | 1 | 1 | 17 SEQ ID NO. 1369 |
| (N20)NGG | 19 | 17940945 | + | TGCGGATGATGGGGATGTGAGCGG | | 1 | 2 | 38 SEQ ID NO. 1370 |
| (N20)NGG | 19 | 17940946 | + | GCGGATGATGGGATGTGAGCGGG | | 1 | 1 | 19 SEQ ID NO. 1371 |
| (N20)NGG | 19 | 17940973 | + | CCCCGCCCTCTGCCGCCTCTTGG | | 1 | 8 | 80 SEQ ID NO. 1372 |
| (N20)NGG | 19 | 17940982 | + | CTGCCGCCTCTTGGAACTGCTGG | | 1 | 3 | 29 SEQ ID NO. 1373 |
| (N20)NGG | 19 | 17940985 | + | CCGCCTCTTGGAACTGCTGGAGG | | 2 | 5 | 31 SEQ ID NO. 1374 |
| (N20)NGG | 19 | 17940988 | + | CCTCTTGGAACTGCTGGAGGAGG | | 1 | 6 | 63 SEQ ID NO. 1375 |
| (N20)NGG | 19 | 17940989 | + | CTCTTGGAACTGCTGGAGGAGGG | | 1 | 3 | 67 SEQ ID NO. 1376 |
| (N20)NGG | 19 | 17940996 | + | AACTGCTGGAGGAGGGCCAGAGG | | 2 | 8 | 91 SEQ ID NO. 1377 |
| (N20)NGG | 19 | 17941003 | + | GGAGGAGGGCCAGAGGCTGCCGG | | 2 | 24 | 274 SEQ ID NO. 1378 |
| (N20)NGG | 19 | 17941027 | + | GCCTCCTGCCTGCCCCTGCTGAGG | | 5 | 32 | 242 SEQ ID NO. 1379 |
| (N20)NGG | 19 | 17941040 | + | CCTGCTGAGGTGAGCGCCGCAGG | | 1 | 1 | 26 SEQ ID NO. 1380 |
| (N20)NGG | 19 | 17941041 | + | CTGCTGAGGTGAGCGCCGCAGGG | | 1 | 2 | 17 SEQ ID NO. 1381 |
| (N20)NGG | 19 | 17940901 | - | AGGAACTCCTGGAGCCAAGGAGG | | 1 | 4 | 96 SEQ ID NO. 1382 |
| (N20)NGG | 19 | 17940904 | - | CGCAGGAACTCCTGGAGCCAAGG | | 1 | 5 | 67 SEQ ID NO. 1383 |
| (N20)NGG | 19 | 17940912 | - | CCATCATCCGCAGAACTCCTGG | | 1 | 1 | 21 SEQ ID NO. 1384 |

FIG. 8 cont.

| site_type | site_chr omosome | site_start_ nucleotide | site_s trand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17940921 | - | GCTCACATCCCATCATCCGCAGG | | 1 | 1 | 10 SEQ ID NO. 1385 |
| (N20)NGG | 19 | 17940951 | - | CCAAGAGGCGGCAGAGGGCGGG | | 1 | 4 | 58 SEQ ID NO. 1386 |
| (N20)NGG | 19 | 17940952 | - | TCCAAGAGGCGGCAGAGGGCGG | | 1 | 2 | 46 SEQ ID NO. 1387 |
| (N20)NGG | 19 | 17940953 | - | TTCCAAGAGGCGGCAGACCCCG | | 2 | 3 | 53 SEQ ID NO. 1388 |
| (N20)NGG | 19 | 17940956 | - | CAGTTCCAAGAGGCGGCAGAGGG | | 1 | 3 | 33 SEQ ID NO. 1389 |
| (N20)NGG | 19 | 17940957 | - | GCAGTTCCAAGAGGCGGCAGAGG | | 1 | 2 | 34 SEQ ID NO. 1390 |
| (N20)NGG | 19 | 17940963 | - | CCTCCAGCAGTTCCAAGAGCGG | | 1 | 6 | 49 SEQ ID NO. 1391 |
| (N20)NGG | 19 | 17940966 | - | CCTCTCCAGCAGTTCCAAGAGG | | 1 | 6 | 64 SEQ ID NO. 1392 |
| (N20)NGG | 19 | 17940990 | - | CAGGAGGCGCCGGCAGCCTCTGG | | 1 | 4 | 60 SEQ ID NO. 1393 |
| (N20)NGG | 19 | 17941000 | - | GCAGGGCAGGCAGGAGGCGCCGG | | 2 | 28 | 284 SEQ ID NO. 1394 |
| (N20)NGG | 19 | 17941006 | - | ACCTCAGCAGGGCAGGCAGGAGG | | 2 | 9 | 170 SEQ ID NO. 1395 |
| (N20)NGG | 19 | 17941009 | - | CTCACCTCAGCAGGGCAGGCAGG | | 1 | 7 | 82 SEQ ID NO. 1396 |
| (N20)NGG | 19 | 17941013 | - | GGGCTCACCTCAGCAGGGCCAGG | | 1 | 2 | 30 SEQ ID NO. 1397 |
| (N20)NGG | 19 | 17941017 | - | CTGCGGCGCTCACCTCAGCAGGG | | 1 | 3 | 15 SEQ ID NO. 1398 |
| (N20)NGG | 19 | 17941018 | - | CCTGCGGCGCTCACCTCAGCAGG | | 1 | 1 | 25 SEQ ID NO. 1399 |
| (N20)NGG | 19 | 17941311 | + | CAAGACCTTGTCCCCTCTCCAGG | | 2 | 4 | 63 SEQ ID NO. 1400 |
| (N20)NGG | 19 | 17941333 | + | GTATGCCCCGAATCCCCTCTCGG | | 1 | 1 | 11 SEQ ID NO. 1401 |
| (N20)NGG | 19 | 17941365 | + | TCTCTGCCAGTCAGACTCTGG | | 1 | 2 | 9 SEQ ID NO. 1402 |
| (N20)NGG | 19 | 17941373 | + | CAGTCAGACGTCTGGAGCTTCGG | | 1 | 5 | 39 SEQ ID NO. 1403 |
| (N20)NGG | 19 | 17941374 | + | AGTCAGACGTCTGGAGCTTCGGG | | 1 | 1 | 15 SEQ ID NO. 1404 |
| (N20)NGG | 19 | 17941375 | + | GTCAGACGTCTGGAGCTTCGGGG | | 1 | 1 | 7 SEQ ID NO. 1405 |
| (N20)NGG | 19 | 17941426 | + | CGACAAAAGCTGCAGCCCCTCGG | | 1 | 2 | 34 SEQ ID NO. 1406 |
| (N20)NGG | 19 | 17941437 | + | GCAGCCCCTCGGCCGTGAGTCGG | | 1 | 2 | 31 SEQ ID NO. 1407 |
| (N20)NGG | 19 | 17941294 | - | GCATACCTGGAGAGGGACAAGG | | 1 | 3 | 70 SEQ ID NO. 1408 |
| (N20)NGG | 19 | 17941300 | - | TCGGGGCATACCTGGAGAGGGG | | 1 | 2 | 25 SEQ ID NO. 1409 |
| (N20)NGG | 19 | 17941301 | - | TTCGGGGCATACCTGGAGAGGG | | 1 | 2 | 24 SEQ ID NO. 1410 |
| (N20)NGG | 19 | 17941302 | - | ATTCGGGGCATACCTGGAGAGG | | 1 | 1 | 11 SEQ ID NO. 1411 |
| (N20)NGG | 19 | 17941307 | - | GAGGGATTCGGGGCATACCTGG | | 1 | 2 | 14 SEQ ID NO. 1412 |
| (N20)NGG | 19 | 17941316 | - | GTTGTCCGAGAGGGATTCGGGG | | 1 | 1 | 3 SEQ ID NO. 1413 |
| (N20)NGG | 19 | 17941317 | - | TGTTGTCCGAGAGGGATTCGGG | | 1 | 1 | 4 SEQ ID NO. 1414 |
| (N20)NGG | 19 | 17941318 | - | ATGTTGTCCGAGAGGGATTCGG | | 1 | 1 | 7 SEQ ID NO. 1415 |
| (N20)NGG | 19 | 17941319 | - | GATGTTGTCCGAGAGGGATTCGG | | 1 | 1 | 13 SEQ ID NO. 1416 |
| (N20)NGG | 19 | 17941325 | - | AGAGAAGATGTTGTCCGAGAGG | | 1 | 2 | 32 SEQ ID NO. 1417 |

FIG. 8 cont.

| site type | site chromosome | site start nucleotide | site strand | target_site_sequence_with_NGG | genome_wide_hits_with_1_or_less_mismatches | genome_wide_hits_with_2_or_less_mismatches | genome_wide_hits_with_3_or_less_mismatches | SEQ ID NO. |
|---|---|---|---|---|---|---|---|---|
| (N20)NGG | 19 | 17941326 | - | GAGAGAAGATGTTGTCCGAGAGG | | 1 | 4 | 26 SEQ ID NO. 1418 |
| (N20)NGG | 19 | 17941350 | - | CGAAGCTCCAGACGTCTGACTGG | | 1 | 1 | 4 SEQ ID NO. 1419 |
| (N20)NGG | 19 | 17941380 | - | AGTAGGTGAAGAGCTCGTACAGG | | 1 | 2 | 6 SEQ ID NO. 1420 |
| (N20)NGG | 19 | 17941397 | - | GCTGCAGCTTTTGTCGCAGTAGG | | 1 | 1 | 17 SEQ ID NO. 1421 |
| (N20)NGG | 19 | 17941419 | - | GAAGCCGACTCACGGCCGAGGGG | | 1 | 1 | 3 SEQ ID NO. 1422 |
| (N20)NGG | 19 | 17941420 | - | GGAAGCCGACTCACGGCCGAGG | | 1 | 1 | 3 SEQ ID NO. 1423 |
| (N20)NGG | 19 | 17941421 | - | GGGAAGCCGACTCACGGCCGAGG | | 1 | 1 | 4 SEQ ID NO. 1424 |
| (N20)NGG | 19 | 17941427 | - | GGCTTCTGGGAAGCCGACTCACGG | | 1 | 4 | 34 SEQ ID NO. 1425 |
| (N20)NGG | 19 | 17942036 | + | CGCTCACACCGCCCGCCCGCAGG | | 2 | 5 | 26 SEQ ID NO. 1426 |
| (N20)NGG | 19 | 17942037 | + | GCTCACACCGCCCGCCCGCAGGG | | 1 | 5 | 22 SEQ ID NO. 1427 |
| (N20)NGG | 19 | 17942042 | + | CACCGCCCGCCCGCAGGGCATGG | | 1 | 2 | 35 SEQ ID NO. 1428 |
| (N20)NGG | 19 | 17942051 | + | CCCGCAGGGCATGGAGTACCTGG | | 1 | 3 | 21 SEQ ID NO. 1429 |
| (N20)NGG | 19 | 17942052 | + | CCGCAGGGCATGGAGTACCTGGG | | 1 | 4 | 24 SEQ ID NO. 1430 |
| (N20)NGG | 19 | 17942081 | + | CCGCTGCGTGCACCGCGACCTGG | | 1 | 1 | 11 SEQ ID NO. 1431 |
| (N20)NGG | 19 | 17942102 | + | GGCCGCCGAAACATCCTCGTGG | | 1 | 1 | 6 SEQ ID NO. 1432 |
| (N20)NGG | 19 | 17942111 | + | AAACATCCTCGTGGAGAGCGAGG | | 1 | 1 | 5 SEQ ID NO. 1433 |
| (N20)NGG | 19 | 17942136 | + | CACGTCAAGATCGCTGACTTCGG | | 2 | 6 | 15 SEQ ID NO. 1434 |
| (N20)NGG | 19 | 17942177 | + | GCTTGACAAAGACTACTACGTGG | | 1 | 1 | 9 SEQ ID NO. 1435 |
| (N20)NGG | 19 | 17942190 | + | TACTACGTGGTCCGGAGCCAGG | | 1 | 1 | 3 SEQ ID NO. 1436 |
| (N20)NGG | 19 | 17942209 | + | CAGGCCAGAGCCCCATTTTCTGG | | 1 | 7 | 63 SEQ ID NO. 1437 |
| (N20)NGG | 19 | 17942212 | + | GCCAGAGCCCCATTTTTCTGGTGG | | 1 | 4 | 52 SEQ ID NO. 1438 |
| (N20)NGG | 19 | 17942213 | + | CCAGAGCCCCATTTTTCTGGTGGG | | 1 | 5 | 52 SEQ ID NO. 1439 |
| (N20)NGG | 19 | 17942214 | + | CAGAGCCCCATTTTTCTGGTGGGG | | 1 | 3 | 56 SEQ ID NO. 1440 |
| (N20)NGG | 19 | 17942228 | + | CTGGTGGGGAACCCGCGCCTAGG | | 1 | 1 | 19 SEQ ID NO. 1441 |
| (N20)NGG | 19 | 17942022 | - | CTCCATGCCCTGCCGGGGGGCGG | | 1 | 2 | 37 SEQ ID NO. 1442 |
| (N20)NGG | 19 | 17942025 | - | GTACTCCATGCCCTGCCGGGGGG | | 1 | 1 | 17 SEQ ID NO. 1443 |
| (N20)NGG | 19 | 17942026 | - | GGTACTCCATGCCCTGCCGGGGG | | 1 | 2 | 17 SEQ ID NO. 1444 |
| (N20)NGG | 19 | 17942029 | - | CCAGGTACTCCATGCCCTGCGG | | 1 | 3 | 54 SEQ ID NO. 1445 |
| (N20)NGG | 19 | 17942030 | - | CCCAGGTACTCCATGCCCTGCGG | | 1 | 3 | 70 SEQ ID NO. 1446 |
| (N20)NGG | 19 | 17942047 | - | GCACCAGCGGGCGGGAGCCCAGG | | 1 | 3 | 42 SEQ ID NO. 1447 |
| (N20)NGG | 19 | 17942055 | - | GTCGCGGTGCACGCAGCGGGGG | | 1 | 1 | 6 SEQ ID NO. 1448 |
| (N20)NGG | 19 | 17942056 | - | GGTCGCGGTGCACCGCAGCGGCGG | | 1 | 1 | 8 SEQ ID NO. 1449 |
| (N20)NGG | 19 | 17942059 | - | CCAGGTCGCGGTGCACGCAGCGG | | 1 | 1 | 15 SEQ ID NO. 1450 |

FIG. 8 cont.

| site type | site chr omosome | site start nucleotide | site strand | target site sequence with NGG | genome wide hits with 1 or less mismatches | genome wide hits with 2 or less mismatches | genome wide hits with 3 or less mismatches | |
|---|---|---|---|---|---|---|---|---|
| (N20)NGG | 19 | 17942071 | - | TGTTTCGGGCGGCCAGGTCGCGG | 2 | 2 | 10 | SEQ ID NO. 1451 |
| (N20)NGG | 19 | 17942077 | - | CGAGGATGTTTCGGGCGGCCAGG | | 6 | 13 | SEQ ID NO. 1452 |
| (N20)NGG | 19 | 17942082 | - | CTCCACGAGGATGTTTCGGGCGG | 1 | 2 | 14 | SEQ ID NO. 1453 |
| (N20)NGG | 19 | 17942085 | - | GCTCTCCACGAGGATGTTTCGGG | 1 | 1 | 17 | SEQ ID NO. 1454 |
| (N20)NGG | 19 | 17942086 | - | CGCTCTCCACGAGGATGTTTCGG | 1 | 1 | 7 | SEQ ID NO. 1455 |
| (N20)NGG | 19 | 17942095 | - | CGTGTGCCTGCTCTCCACGAGG | 1 | 1 | 13 | SEQ ID NO. 1456 |
| (N20)NGG | 19 | 17942137 | - | CAAGCGGCAGCAGCTTAGCTAGG | 1 | 1 | 32 | SEQ ID NO. 1457 |
| (N20)NGG | 19 | 17942153 | - | ACGTAGTAGTCTTTGTCAAGCGG | | 1 | 12 | SEQ ID NO. 1458 |
| (N20)NGG | 19 | 17942179 | - | TGGGGCTTCTGCCTGGCTCGCGG | 2 | 5 | 79 | SEQ ID NO. 1459 |
| (N20)NGG | 19 | 17942186 | - | CAGAAAATGGGGCTCTGGCCTGG | 1 | 7 | 80 | SEQ ID NO. 1460 |
| (N20)NGG | 19 | 17942191 | - | CCCACCAGAAAATGGGGCTCTGG | 1 | 5 | 46 | SEQ ID NO. 1461 |
| (N20)NGG | 19 | 17942197 | - | GGGTTCCCACCAGAAAATGGGG | 1 | 2 | 32 | SEQ ID NO. 1462 |
| (N20)NGG | 19 | 17942198 | - | CGGGTTCCCACCAGAAAATGGG | 1 | 3 | 19 | SEQ ID NO. 1463 |
| (N20)NGG | 19 | 17942199 | - | GCGGGTTCCCACCAGAAAATGG | 1 | 1 | 17 | SEQ ID NO. 1464 |
| (N20)NGG | 19 | 17942482 | + | TGACAGATCTGCCTTCTCCAGG | 1 | 4 | 66 | SEQ ID NO. 1465 |
| (N20)NGG | 19 | 17942498 | + | CTCCAGGCCGCCAGAGCCTGCGG | 1 | 12 | 92 | SEQ ID NO. 1466 |
| (N20)NGG | 19 | 17942502 | + | AGGCCGCCAGAGCCTGCGGCTGG | 2 | 3 | 29 | SEQ ID NO. 1467 |
| (N20)NGG | 19 | 17942508 | + | CCAGAGCCTGCGGCTGGTCATGG | 1 | 4 | 75 | SEQ ID NO. 1468 |
| (N20)NGG | 19 | 17942524 | + | GTCATGGAGTACCTGCCCAGCGG | 1 | 4 | 41 | SEQ ID NO. 1469 |
| (N20)NGG | 19 | 17942549 | + | GCTGCGCGACTTCCTGCAGCGG | 1 | 1 | 12 | SEQ ID NO. 1470 |
| (N20)NGG | 19 | 17942607 | + | CTATTCCTCGCAGATCTGCAAGG | 1 | 2 | 14 | SEQ ID NO. 1471 |
| (N20)NGG | 19 | 17942614 | + | TCGCAGATCTGCAAGGTGCGAGG | 1 | 3 | 14 | SEQ ID NO. 1472 |
| (N20)NGG | 19 | 17942615 | + | CGCAGATCTGCAAGGTGCGAGGG | 1 | 3 | 9 | SEQ ID NO. 1473 |
| (N20)NGG | 19 | 17942616 | + | GCAGATCTGCAAGGTGCGAGGGG | 1 | 3 | 25 | SEQ ID NO. 1474 |
| (N20)NGG | 19 | 17942617 | + | CAGATCTGCAAGGTGCGAGGGGG | 1 | 2 | 28 | SEQ ID NO. 1475 |
| (N20)NGG | 19 | 17942625 | + | CAAGGTGCGAGGGGGCGCCCGG | 1 | 1 | 25 | SEQ ID NO. 1476 |
| (N20)NGG | 19 | 17942626 | + | AAGGTGCGAGGGGGCGCCCCGGG | 1 | 2 | 16 | SEQ ID NO. 1477 |
| (N20)NGG | 19 | 17942468 | - | TCTGGGCCTTGCAGAAGGCAGG | 1 | 20 | 75 | SEQ ID NO. 1478 |
| (N20)NGG | 19 | 17942472 | - | AGGCTCTGGCCTTGCAGAAGG | 1 | 10 | 74 | SEQ ID NO. 1479 |
| (N20)NGG | 19 | 17942478 | - | AGCCCAGGCTCTGGCCTTGCGG | 1 | 3 | 36 | SEQ ID NO. 1480 |
| (N20)NGG | 19 | 17942483 | - | TGACCAGCCGCCAGGCTCTGGCGG | 1 | 5 | 49 | SEQ ID NO. 1481 |
| (N20)NGG | 19 | 17942486 | - | CCATGACCAGCCCGCAGGCTCTGG | 1 | 1 | 29 | SEQ ID NO. 1482 |
| (N20)NGG | 19 | 17942492 | - | GGTACTCCATGACCAGCCGCAGG | 1 | 1 | 10 | SEQ ID NO. 1483 |

FIG. 8 cont.

| site type | site chromosome | site start nucleotide | site strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17942513 | - | CGCGCAAGCAGCCGCTGGGCAGG | 1 | 1 | 8 | SEQ ID NO. 1484 |
| (N20)NGG | 19 | 17942517 | - | AAGTCGCGCAAGCAGCCGCTGGG | 1 | 1 | 3 | SEQ ID NO. 1485 |
| (N20)NGG | 19 | 17942518 | - | GAAGTCGCGCAAGCAGCCGCTGG | 1 | 1 | 1 | SEQ ID NO. 1486 |
| (N20)NGG | 19 | 17942540 | - | GGCGCGGCGGGTGCCCGCTGCAGG | 1 | 2 | 38 | SEQ ID NO. 1487 |
| (N20)NGG | 19 | 17942552 | - | GGCTGGCATCGAGGCGCGCGCGG | 1 | 4 | 15 | SEQ ID NO. 1488 |
| (N20)NGG | 19 | 17942561 | - | GAAGGAGGCGGCTGGCATCGAGG | 1 | 2 | 28 | SEQ ID NO. 1489 |
| (N20)NGG | 19 | 17942569 | - | GGAATAGAGAAGGAGGCGGCTGG | 1 | 5 | 66 | SEQ ID NO. 1490 |
| (N20)NGG | 19 | 17942573 | - | GCCGAGGAATAGAGAAGGAGGCGG | 1 | 9 | 243 | SEQ ID NO. 1491 |
| (N20)NGG | 19 | 17942576 | - | TCTGCGAGGAATAGAGAAGGAGG | 1 | 4 | 45 | SEQ ID NO. 1492 |
| (N20)NGG | 19 | 17942579 | - | AGATCTGCGAGGAATAGAGAAGG | 1 | 6 | 38 | SEQ ID NO. 1493 |
| (N20)NGG | 19 | 17942590 | - | TCGCACCTTGCAGATCTGCGAGG | 1 | 1 | 11 | SEQ ID NO. 1494 |
| (N20)NGG | 19 | 17943327 | + | CATCAGTCCCGCTATCCCCCAGG | 1 | 1 | 10 | SEQ ID NO. 1495 |
| (N20)NGG | 19 | 17943328 | + | ATCAGTCCCGCTATCCCCCAGGG | 1 | 1 | 14 | SEQ ID NO. 1496 |
| (N20)NGG | 19 | 17943337 | + | GCTATCCCCCAGGGCAACTTTGG | 1 | 1 | 20 | SEQ ID NO. 1497 |
| (N20)NGG | 19 | 17943345 | + | CCAGGCAACTTTGGCAGCGTGG | 1 | 2 | 17 | SEQ ID NO. 1498 |
| (N20)NGG | 19 | 17943370 | + | CTGTGCCGCTATGACCCGCTAGG | 1 | 1 | 6 | SEQ ID NO. 1499 |
| (N20)NGG | 19 | 17943382 | + | GACCCGCTAGGCGACAATACAGG | 1 | 1 | 3 | SEQ ID NO. 1500 |
| (N20)NGG | 19 | 17943390 | + | AGGCGACAATACAGTGCCCTGG | 1 | 2 | 10 | SEQ ID NO. 1501 |
| (N20)NGG | 19 | 17943393 | + | CGACAATACAGGTGCCCTGGTGG | 1 | 2 | 12 | SEQ ID NO. 1502 |
| (N20)NGG | 19 | 17943418 | + | GTGAAACAGCTGCACCACAGCGG | 2 | 3 | 70 | SEQ ID NO. 1503 |
| (N20)NGG | 19 | 17943419 | + | TGAAACAGCTGCACCACAGCGGG | 2 | 4 | 97 | SEQ ID NO. 1504 |
| (N20)NGG | 19 | 17943434 | - | ACAGCGGGCCAGACCAGCAGAGG | 1 | 1 | 33 | SEQ ID NO. 1505 |
| (N20)NGG | 19 | 17943435 | - | CAGCGGGCCAGACCAGCAGAGGG | 1 | 3 | 30 | SEQ ID NO. 1506 |
| (N20)NGG | 19 | 17943446 | + | ACCAGCAGAGGGACTTTCAGCGG | 1 | 5 | 71 | SEQ ID NO. 1507 |
| (N20)NGG | 19 | 17943447 | + | CCAGCAGAGGGACTTTCAGCGGG | 1 | 5 | 65 | SEQ ID NO. 1508 |
| (N20)NGG | 19 | 17943499 | + | GATTTCATTGTCAAGTATCGTGG | 1 | 2 | 15 | SEQ ID NO. 1509 |
| (N20)NGG | 19 | 17943511 | + | AAGTATCGTGGTGTCAGCTATGG | 1 | 1 | 20 | SEQ ID NO. 1510 |
| (N20)NGG | 19 | 17943516 | + | TCGTGTGTCAGCTATGGCCCGG | 1 | 3 | 19 | SEQ ID NO. 1511 |
| (N20)NGG | 19 | 17943517 | + | CGTGGTGTCAGCTATGGCCCGGG | 2 | 11 | 26 | SEQ ID NO. 1512 |
| (N20)NGG | 19 | 17943532 | + | GGCCCGGTGAGCCAGCTCCCGG | 1 | 2 | 50 | SEQ ID NO. 1513 |
| (N20)NGG | 19 | 17943312 | - | AAGTTGCCCTGGGGATAGCGGG | 1 | 1 | 16 | SEQ ID NO. 1514 |
| (N20)NGG | 19 | 17943313 | - | AAAGTTGCCCTGGGGATAGCGG | 1 | 3 | 37 | SEQ ID NO. 1515 |
| (N20)NGG | 19 | 17943320 | - | CGCTGCCAAAGTTGCCCTGGGGG | 1 | 1 | 18 | SEQ ID NO. 1516 |

FIG. 8 cont.

| site_type | site_chr omosome | site_start_ nucleotide | site_s trand | target_site_sequence_with_NGG | genome_wide_hits_with_1_or_less_mism atches | genome_wide_hits_with_2_or_less_mism atches | genome_wide_hits_with_3_or_less_mism atches | |
|---|---|---|---|---|---|---|---|---|
| (N20)NGG | 19 | 17943321 | - | ACGCTGCCAAAGTTGCCCTGGGG | 1 | 2 | 22 | SEQ ID NO. 1517 |
| (N20)NGG | 19 | 17943322 | - | CCAGCTGCCAAAGTTGCCCTGGG | 1 | 1 | 13 | SEQ ID NO. 1518 |
| (N20)NGG | 19 | 17943323 | - | CCACGCTGCCAAAGTTGCCCTGG | 1 | 2 | 18 | SEQ ID NO. 1519 |
| (N20)NGG | 19 | 17943353 | - | TGTCGCCTAGCGGGTCATAGCGG | 1 | 1 | 4 | SEQ ID NO. 1520 |
| (N20)NGG | 19 | 17943362 | - | CACCTGTATTGTCGCCTAGCGGG | 1 | 1 | 5 | SEQ ID NO. 1521 |
| (N20)NGG | 19 | 17943363 | - | GCACCTGTATTGTCGCCTAGCGG | 1 | 1 | 5 | SEQ ID NO. 1522 |
| (N20)NGG | 19 | 17943385 | - | CAGCTGTTTCACGGCCACCAGGG | 1 | 3 | 21 | SEQ ID NO. 1523 |
| (N20)NGG | 19 | 17943386 | - | GCAGCTGTTTCACGGCCACCAGG | 1 | 3 | 17 | SEQ ID NO. 1524 |
| (N20)NGG | 19 | 17943394 | - | GCTGTGCTGCAGCTGTTTCACGG | 2 | 3 | 57 | SEQ ID NO. 1525 |
| (N20)NGG | 19 | 17943420 | - | TGAAAGTCCCTCTGCTGGTCTGG | 1 | 4 | 42 | SEQ ID NO. 1526 |
| (N20)NGG | 19 | 17943425 | - | CCCGCTGAAAGTCCCTCTGCTGG | 1 | 2 | 15 | SEQ ID NO. 1527 |
| (N20)NGG | 19 | 17943458 | - | AATCACTGTGCAGTGCTTTGAGG | 1 | 1 | 73 | SEQ ID NO. 1528 |
| (N20)NGG | 19 | 17943512 | - | ATCCGGGAGCTGGCTCACCCGGG | 1 | 2 | 19 | SEQ ID NO. 1529 |
| (N20)NGG | 19 | 17943513 | - | CATCCGGGAGCTGGCTCACCCGG | 1 | 3 | 24 | SEQ ID NO. 1530 |
| (N20)NGG | 19 | 17943628 | + | CTCCTCTCAGACCCACACCTGG | 3 | 14 | 136 | SEQ ID NO. 1531 |
| (N20)NGG | 19 | 17943636 | + | GACCCCACACCTGGTGCCCTGG | 2 | 7 | 51 | SEQ ID NO. 1532 |
| (N20)NGG | 19 | 17943649 | + | GGTGCCCTGGCACCTCGTGATGG | 1 | 1 | 17 | SEQ ID NO. 1533 |
| (N20)NGG | 19 | 17943650 | + | GTGCCCTGGCACCTCGTGATGGG | 1 | 2 | 9 | SEQ ID NO. 1534 |
| (N20)NGG | 19 | 17943656 | + | TGGCACCTCGTGATGGCTGTGG | 1 | 1 | 27 | SEQ ID NO. 1535 |
| (N20)NGG | 19 | 17943661 | + | CCTCGTGATGGCGTGTGGAATGG | 2 | 4 | 24 | SEQ ID NO. 1536 |
| (N20)NGG | 19 | 17943702 | + | CCAAGACCCCACGATCTTCGAGG | 1 | 1 | 5 | SEQ ID NO. 1537 |
| (N20)NGG | 19 | 17943732 | + | CCTCAAGTACATCTCACAGCTGG | 1 | 3 | 38 | SEQ ID NO. 1538 |
| (N20)NGG | 19 | 17943733 | + | CTCAAGTACATCTCACAGCTGGG | 1 | 3 | 43 | SEQ ID NO. 1539 |
| (N20)NGG | 19 | 17943738 | + | GTACATCTCACAGCTGGGCAAGG | 1 | 2 | 51 | SEQ ID NO. 1540 |
| (N20)NGG | 19 | 17943743 | + | TCTCACAGCTGGGCAAGGTAAGG | 1 | 5 | 66 | SEQ ID NO. 1541 |
| (N20)NGG | 19 | 17943746 | + | CACAGCTGGGCAAGGTAAGGTGG | 2 | 7 | 85 | SEQ ID NO. 1542 |
| (N20)NGG | 19 | 17943747 | + | ACAGCTGGGCAAGGTAAGGTGGG | 1 | 2 | 45 | SEQ ID NO. 1543 |
| (N20)NGG | 19 | 17943751 | + | CTGGGCAAGGTAAGGTGGGCAGG | 1 | 4 | 67 | SEQ ID NO. 1544 |
| (N20)NGG | 19 | 17943752 | + | TGGGCAAGGTAAGGTGGGCAGGG | 1 | 5 | 107 | SEQ ID NO. 1545 |
| (N20)NGG | 19 | 17943757 | + | AAGGTAAGGTGGGCAGGGCCAGG | 2 | 9 | 141 | SEQ ID NO. 1546 |
| (N20)NGG | 19 | 17943758 | + | AGGTAAGGTGGGCAGGGCCAGGG | 3 | 15 | 128 | SEQ ID NO. 1547 |
| (N20)NGG | 19 | 17943761 | + | TAAGGTGGGCAGGGCCAGGGTGG | 1 | 11 | 220 | SEQ ID NO. 1548 |
| (N20)NGG | 19 | 17943762 | + | AAGGTGGGCAGGGCCAGGGTGGG | 2 | 25 | 282 | SEQ ID NO. 1549 |

FIG. 8 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 19 | 17943574 | - | TGGGGTGGGGCATGGGCAGTGG | | 6 | 54 | 656 | SEQ ID NO. 1550 |
| (N20)NGG | 19 | 17943580 | - | ATAGTCTGGGTGGGGGCATGG | | 1 | 5 | 88 | SEQ ID NO. 1551 |
| (N20)NGG | 19 | 17943581 | - | CATAGTCTGGGTGGGGCATGG | | 1 | 10 | 133 | SEQ ID NO. 1552 |
| (N20)NGG | 19 | 17943586 | - | GAGCTCATAGTCTGGGTGGGG | | 3 | 10 | 112 | SEQ ID NO. 1553 |
| (N20)NGG | 19 | 17943587 | - | GGAGCTCATAGTCTGGGGTGG | | 2 | 12 | 80 | SEQ ID NO. 1554 |
| (N20)NGG | 19 | 17943588 | - | AGGAGCTCATAGTCTGGGGTGG | | 1 | 13 | 121 | SEQ ID NO. 1555 |
| (N20)NGG | 19 | 17943589 | - | GAGGAGCTCATAGTCTGGGGTG | | 1 | 14 | 149 | SEQ ID NO. 1556 |
| (N20)NGG | 19 | 17943592 | - | TGAGAGGAGCTCATAGTCTGG | | 1 | 3 | 54 | SEQ ID NO. 1557 |
| (N20)NGG | 19 | 17943593 | - | CTGAGAGGAGCTCATAGTCTGG | | 1 | 4 | 51 | SEQ ID NO. 1558 |
| (N20)NGG | 19 | 17943594 | - | TCTGAGAGGAGCTCATAGTCTG | | 1 | 5 | 48 | SEQ ID NO. 1559 |
| (N20)NGG | 19 | 17943608 | - | CACCAGGTGTGGGTCTTGAGAGG | | 1 | 6 | 70 | SEQ ID NO. 1560 |
| (N20)NGG | 19 | 17943617 | - | GTGCCAGGGCACCAGGTGTGGG | | 4 | 14 | 64 | SEQ ID NO. 1561 |
| (N20)NGG | 19 | 17943618 | - | GGTGCCAGGGCACCAGGTGTGG | | 3 | 11 | 64 | SEQ ID NO. 1562 |
| (N20)NGG | 19 | 17943619 | - | AGGTGCCAGGGCACCAGGTGTG | | 2 | 6 | 82 | SEQ ID NO. 1563 |
| (N20)NGG | 19 | 17943624 | - | TCACGAGGTGCCAGGGCACCAGG | | 1 | 1 | 23 | SEQ ID NO. 1564 |
| (N20)NGG | 19 | 17943631 | - | CAGCCCATCACGAGGTGCCAGG | | 1 | 2 | 21 | SEQ ID NO. 1565 |
| (N20)NGG | 19 | 17943632 | - | ACAGCCCATCACGAGGTGCCAG | | 1 | 3 | 11 | SEQ ID NO. 1566 |
| (N20)NGG | 19 | 17943639 | - | CCATTCCACAGCCCATCACGAGG | | 2 | 3 | 24 | SEQ ID NO. 1567 |
| (N20)NGG | 19 | 17943664 | - | GTCTTGGCAGCATAGAGCTGG | | 1 | 3 | 36 | SEQ ID NO. 1568 |
| (N20)NGG | 19 | 17943665 | - | GGTCTTGGCAGCATAGAGCTG | | 2 | 5 | 53 | SEQ ID NO. 1569 |
| (N20)NGG | 19 | 17943676 | - | GAAGATCGTGGGTCTTGGCAGG | | 1 | 2 | 24 | SEQ ID NO. 1570 |
| (N20)NGG | 19 | 17943680 | - | CCTCGAAGATCGTGGGTCTTGG | | 1 | 1 | 7 | SEQ ID NO. 1571 |
| (N20)NGG | 19 | 17943686 | - | GTCTCTCCTCGAAGATCGTGGG | | 1 | 2 | 5 | SEQ ID NO. 1572 |
| (N20)NGG | 19 | 17943687 | - | TGTCTCTCCTCGAAGATCGTGG | | 1 | 1 | 6 | SEQ ID NO. 1573 |
| (N20)NGG | 19 | 17943688 | - | GTGTCTCTCCTCGAAGATCGTGG | | 1 | 2 | 7 | SEQ ID NO. 1574 |
| (N20)NGG | 19 | 17943710 | - | CCAGCTGTGAGATGTACTTGAGG | | 1 | 2 | 37 | SEQ ID NO. 1575 |
| (N20)NGG | 19 | 17945397 | + | TCAGAAACTCCAATTTTATGAGG | | 1 | 7 | 86 | SEQ ID NO. 1576 |
| (N20)NGG | 19 | 17945402 | + | AACTCCAATTTTATGAGGACCGG | | 1 | 3 | 40 | SEQ ID NO. 1577 |
| (N20)NGG | 19 | 17945415 | + | TGAGGACCGGCAGCAGTGCCGG | | 1 | 6 | 66 | SEQ ID NO. 1578 |
| (N20)NGG | 19 | 17945426 | + | AGCAGTGCCGGCCCCCAAGTGG | | 1 | 1 | 43 | SEQ ID NO. 1579 |
| (N20)NGG | 19 | 17945436 | + | GGCCCCAAGTGACAGAGCTGG | | 1 | 4 | 67 | SEQ ID NO. 1580 |
| (N20)NGG | 19 | 17945460 | + | CCTGCTGATTCAACAGTGCATGG | | 1 | 3 | 37 | SEQ ID NO. 1581 |
| (N20)NGG | 19 | 17945472 | + | ACAGTGCATGGCCTATGAGCCGG | | 1 | 2 | 32 | SEQ ID NO. 1582 |

FIG. 8 cont.

| site_type | site_chr omosome | site_start_ nucleotide | site_s trand | target_site_sequence_wit h_NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 19 | 17945480 | + | TGGCCTATGAGCCGGTCCAGAGG | | 1 | 2 | 15 SEQ ID NO. 1583 |
| (N20)NGG | 19 | 17945530 | + | CTCAATAGCCTCATCTCTTCAGG | | 1 | 2 | 45 SEQ ID NO. 1584 |
| (N20)NGG | 19 | 17945540 | + | TCATCTCTTCAGGTGCCCGCTGG | | 1 | 2 | 16 SEQ ID NO. 1585 |
| (N20)NGG | 19 | 17945541 | + | CATCTCTTCAGTGCCCGCTGG | | 2 | 2 | 25 SEQ ID NO. 1586 |
| (N20)NGG | 19 | 17945545 | + | TCTTCAGGTGCCCGCTGGGACGG | | 2 | 2 | 27 SEQ ID NO. 1587 |
| (N20)NGG | 19 | 17945546 | + | CTTCAGGTGCCCGCTGGGACGGG | | 1 | 3 | 24 SEQ ID NO. 1588 |
| (N20)NGG | 19 | 17945550 | + | AGGTGCCCGCTGGGACGGGTTCG | | 1 | 2 | 12 SEQ ID NO. 1589 |
| (N20)NGG | 19 | 17945551 | + | GGTGCCCGCTGGGACGGGTTGGG | | 1 | 2 | 18 SEQ ID NO. 1590 |
| (N20)NGG | 19 | 17945554 | + | GCCCGCTGGGACGGGTTGGGTGG | | 1 | 1 | 22 SEQ ID NO. 1591 |
| (N20)NGG | 19 | 17945356 | - | CTGAGGGTGAGAGGAGCAGTCGG | | 1 | 6 | 131 SEQ ID NO. 1592 |
| (N20)NGG | 19 | 17945365 | - | TTGGAGTTTCTGAGGGTGAGAGG | | 1 | 10 | 100 SEQ ID NO. 1593 |
| (N20)NGG | 19 | 17945372 | - | CATAAAATTGGAGTTTCTGAGGG | | 1 | 8 | 117 SEQ ID NO. 1594 |
| (N20)NGG | 19 | 17945373 | - | TCATAAAATTGGAGTTTCTGAGG | | 1 | 10 | 88 SEQ ID NO. 1595 |
| (N20)NGG | 19 | 17945384 | - | GCTGCCGGTCCTCATAAAATTGG | | 1 | 2 | 12 SEQ ID NO. 1596 |
| (N20)NGG | 19 | 17945399 | - | TGGGGGCCGGCAGCTGCTGCCGG | | 1 | 8 | 83 SEQ ID NO. 1597 |
| (N20)NGG | 19 | 17945412 | - | AGCTCTGTCCACTTGGGGGCCGG | | 1 | 4 | 66 SEQ ID NO. 1598 |
| (N20)NGG | 19 | 17945416 | - | GGCCAGCTCTGTCCACTTGGGGG | | 1 | 11 | 71 SEQ ID NO. 1599 |
| (N20)NGG | 19 | 17945417 | - | GGGCCAGCTCTGTCCACTTGGGG | | 1 | 5 | 58 SEQ ID NO. 1600 |
| (N20)NGG | 19 | 17945418 | - | AGGGCCAGCTCTGTCCACTTGGG | | 1 | 7 | 74 SEQ ID NO. 1601 |
| (N20)NGG | 19 | 17945419 | - | CAGGGCCAGCTCTGTCCACTTGG | | 2 | 7 | 118 SEQ ID NO. 1602 |
| (N20)NGG | 19 | 17945437 | - | CATGCACTGTTGAATCAGCAGGG | | 1 | 3 | 32 SEQ ID NO. 1603 |
| (N20)NGG | 19 | 17945438 | - | CCATGCACTGTTGAATCAGCAGG | | 2 | 2 | 27 SEQ ID NO. 1604 |
| (N20)NGG | 19 | 17945461 | - | GGGCCTCTGGACCGGCTCATAGG | | 1 | 2 | 19 SEQ ID NO. 1605 |
| (N20)NGG | 19 | 17945469 | - | CGGAAGGAGGGCCTCTGGACCGG | | 1 | 2 | 23 SEQ ID NO. 1606 |
| (N20)NGG | 19 | 17945474 | - | CCGCTCGGAAGGAGGGCCTCTGG | | 1 | 2 | 12 SEQ ID NO. 1607 |
| (N20)NGG | 19 | 17945481 | - | CGAATGACGGCTCGGAAGGAGGG | | 1 | 1 | 4 SEQ ID NO. 1608 |
| (N20)NGG | 19 | 17945482 | - | ACGAATGACGGCTCGGAAGGAGG | | 1 | 1 | 4 SEQ ID NO. 1609 |
| (N20)NGG | 19 | 17945485 | - | GTCACGAATGACGGCTCGGAAGG | | 1 | 1 | 1 SEQ ID NO. 1610 |
| (N20)NGG | 19 | 17945489 | - | TGAGGTCACGAATGACGGCTCGG | | 1 | 1 | 9 SEQ ID NO. 1611 |
| (N20)NGG | 19 | 17945494 | - | GCTATTGAGGTCACGAATGACGG | | 1 | 1 | 15 SEQ ID NO. 1612 |
| (N20)NGG | 19 | 17945507 | - | CTGAAGAGATGAGGCTATTGAGG | | 1 | 3 | 54 SEQ ID NO. 1613 |
| (N20)NGG | 19 | 17945516 | - | AGCGGGCACCTGAAGAGATGAGG | | 1 | 3 | 26 SEQ ID NO. 1614 |
| (N20)NGG | 19 | 17945673 | + | TTCCCTCAGTGCTCACCGACAGG | | 1 | 1 | 25 SEQ ID NO. 1615 |

FIG. 8 cont.

| site_type | site_chr omosome | site_start_ nucleotide | site_s trand | target_site_sequence_with_NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 19 | 17945682 | + | TGCTCACCGACAGGATCCCCTGG | 1 | 2 | 14 | SEQ ID NO. 1616 |
| (N20)NGG | 19 | 17945683 | + | GCTCACCGACAGGATCCCCTGGG | 1 | 2 | 12 | SEQ ID NO. 1617 |
| (N20)NGG | 19 | 17945686 | + | CACCGACAGGATCCCCTGGGTGG | 1 | 2 | 16 | SEQ ID NO. 1618 |
| (N20)NGG | 19 | 17945703 | + | GGGTGGCCCCGAGTGTCTCCGG | 1 | 1 | 13 | SEQ ID NO. 1619 |
| (N20)NGG | 19 | 17945704 | + | GGTGGCCCCGAGTGTCTCCGGG | 1 | 2 | 27 | SEQ ID NO. 1620 |
| (N20)NGG | 19 | 17945707 | + | GGCCCCGAGTGTCTCCGGGAGG | 1 | 2 | 24 | SEQ ID NO. 1621 |
| (N20)NGG | 19 | 17945725 | + | GGAGGCGCAGACACTTAGCTTGG | 1 | 1 | 9 | SEQ ID NO. 1622 |
| (N20)NGG | 19 | 17945739 | + | TTAGCTTGGAAGCTGACAAGTGG | 1 | 2 | 29 | SEQ ID NO. 1623 |
| (N20)NGG | 19 | 17945740 | + | TAGCTTGGAAGCTGACAAGTGGG | 1 | 5 | 33 | SEQ ID NO. 1624 |
| (N20)NGG | 19 | 17945741 | + | AGCTTGGAAGCTGACAAGTGGGG | 1 | 3 | 47 | SEQ ID NO. 1625 |
| (N20)NGG | 19 | 17945747 | + | GAAGCTGACAAGTGGGGCTTCGG | 1 | 2 | 38 | SEQ ID NO. 1626 |
| (N20)NGG | 19 | 17945755 | + | CAAGTGGGGCTTCGCGCCACGG | 1 | 1 | 8 | SEQ ID NO. 1627 |
| (N20)NGG | 19 | 17945760 | + | GGGGCTTCGCGCCACGGTCTGG | 1 | 1 | 9 | SEQ ID NO. 1628 |
| (N20)NGG | 19 | 17945761 | + | GGGCTTCGCGCCACGGTCTGGG | 1 | 1 | 8 | SEQ ID NO. 1629 |
| (N20)NGG | 19 | 17945774 | + | ACGGTCTGGGAAGTGTTTAGTGG | 1 | 1 | 16 | SEQ ID NO. 1630 |
| (N20)NGG | 19 | 17945800 | + | CACCATGCCCATCAGTGCCCTGG | 1 | 8 | 63 | SEQ ID NO. 1631 |
| (N20)NGG | 19 | 17945812 | + | CAGTGCCCTGGATCCTGCTAAGG | 1 | 4 | 51 | SEQ ID NO. 1632 |
| (N20)NGG | 19 | 17945830 | + | TAAGGTCAGAGCCCCTCACCCGG | 1 | 2 | 38 | SEQ ID NO. 1633 |
| (N20)NGG | 19 | 17945836 | + | CAGAGCCCCTCACCCGGCATCGG | 1 | 3 | 43 | SEQ ID NO. 1634 |
| (N20)NGG | 19 | 17945635 | - | CAGGGAATGAAAGTGGGATCAGG | 1 | 7 | 74 | SEQ ID NO. 1635 |
| (N20)NGG | 19 | 17945641 | - | AGCACTGAGGGAATGAAAGTGGG | 1 | 8 | 86 | SEQ ID NO. 1636 |
| (N20)NGG | 19 | 17945642 | - | GAGCACTGAGGGAATGAAAGTGG | 1 | 8 | 106 | SEQ ID NO. 1637 |
| (N20)NGG | 19 | 17945653 | - | ATCCTGTCGGTGAGCACTGAGG | 1 | 1 | 16 | SEQ ID NO. 1638 |
| (N20)NGG | 19 | 17945654 | - | GATCCTGTCGGTGAGCACTGAGG | 1 | 2 | 15 | SEQ ID NO. 1639 |
| (N20)NGG | 19 | 17945666 | - | GGCCACCCAGGGGATCCTGTCGG | 1 | 2 | 36 | SEQ ID NO. 1640 |
| (N20)NGG | 19 | 17945676 | - | GACACTGGGGGCCACCCAGGGG | 1 | 2 | 18 | SEQ ID NO. 1641 |
| (N20)NGG | 19 | 17945677 | - | AGACACTGGGGGCCACCCAGG | 1 | 1 | 25 | SEQ ID NO. 1642 |
| (N20)NGG | 19 | 17945678 | - | GAGACACTGGGGGCCACCAGG | 1 | 1 | 16 | SEQ ID NO. 1643 |
| (N20)NGG | 19 | 17945687 | - | CGCCTCCCGAGACACTCGGGG | 1 | 2 | 11 | SEQ ID NO. 1644 |
| (N20)NGG | 19 | 17945688 | - | GCGCCTCCCGAGACACTCGGGG | 1 | 2 | 13 | SEQ ID NO. 1645 |
| (N20)NGG | 19 | 17945689 | - | TGCGCCTCCCGAGACACTCGG | 1 | 1 | 14 | SEQ ID NO. 1646 |
| (N20)NGG | 19 | 17945690 | - | CTGCGCCTCCCGAGACACTCGG | 1 | 2 | 32 | SEQ ID NO. 1647 |
| (N20)NGG | 19 | 17945700 | - | AGCTAAGTGTCTGCGCCTCCCGG | 1 | 1 | 11 | SEQ ID NO. 1648 |

FIG. 8 cont.

| site_type | site_chromosome | site_start_nucleotide | site_strand | target_site_sequence with h NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17945750 | - | ACTAAACACTTCCAGACCGTGG | 1 | | 2 | 14 SEQ ID NO. 1649 |
| (N20)NGG | 19 | 17945780 | - | ATCCAGGGCACTGATGGGCATGG | 1 | | 5 | 64 SEQ ID NO. 1650 |
| (N20)NGG | 19 | 17945785 | - | GCAGGATCCAGGGCACTGATGGG | 2 | | 7 | 75 SEQ ID NO. 1651 |
| (N20)NGG | 19 | 17945786 | - | AGCAGGATCCAGGGCACTGATGG | 1 | | 10 | 73 SEQ ID NO. 1652 |
| (N20)NGG | 19 | 17945795 | - | TCTGACCTTAGCAGGATCCAGGG | | 1 | | 26 SEQ ID NO. 1653 |
| (N20)NGG | 19 | 17945796 | - | CTCTGACCTTAGCAGGATCCAGG | 1 | | 2 | 25 SEQ ID NO. 1654 |
| (N20)NGG | 19 | 17945803 | - | TGAGGGGCTCTGACCTTAGCAGG | | | 3 | 36 SEQ ID NO. 1655 |
| (N20)NGG | 19 | 17945891 | + | TTCCTGTGTCTGGCCCCCTTAGG | 1 | | 6 | 38 SEQ ID NO. 1656 |
| (N20)NGG | 19 | 17945894 | + | CTGTGTCTGGCCCCCTTAGGAGG | 1 | | 2 | 37 SEQ ID NO. 1657 |
| (N20)NGG | 19 | 17945901 | + | TGGCCCCCTTAGGAGGACAAAGG | 1 | | 1 | 26 SEQ ID NO. 1658 |
| (N20)NGG | 19 | 17945913 | + | GAGGACAAAGGCTCTGCCCCATGG | 1 | | 1 | 82 SEQ ID NO. 1659 |
| (N20)NGG | 19 | 17945929 | + | CCCATGCAATGTCTCTGCCCGG | 1 | | 4 | 46 SEQ ID NO. 1660 |
| (N20)NGG | 19 | 17945933 | + | TGGCAATGTCTCTGCCCGGAAGG | 1 | | 3 | 31 SEQ ID NO. 1661 |
| (N20)NGG | 19 | 17945942 | + | CTCTGCCCGGAAGGTGCTCCTGG | 3 | | 3 | 60 SEQ ID NO. 1662 |
| (N20)NGG | 19 | 17945947 | + | CCCGGAAGGTGCTCCTGGCTCGG | 1 | | 4 | 52 SEQ ID NO. 1663 |
| (N20)NGG | 19 | 17945948 | + | CCGGAAGGTGCTCCTGGCTCGGG | 1 | | 3 | 33 SEQ ID NO. 1664 |
| (N20)NGG | 19 | 17945951 | + | GAAGGTGCTCCTGGCTCGGGAGG | 1 | | 2 | 38 SEQ ID NO. 1665 |
| (N20)NGG | 19 | 17945952 | + | AAGGTGCTCCTGGCTCGGGAGGG | 1 | | 2 | 32 SEQ ID NO. 1666 |
| (N20)NGG | 19 | 17945953 | + | AGGTGCTCCTGGCTCGGGAGGGG | 1 | | 2 | 58 SEQ ID NO. 1667 |
| (N20)NGG | 19 | 17945954 | + | GGTGCTCCTGGCTCGGGAGGGGG | 1 | | 4 | 61 SEQ ID NO. 1668 |
| (N20)NGG | 19 | 17945961 | + | CTGGCTCGGGAGGGGGCTGATGG | 1 | | 6 | 71 SEQ ID NO. 1669 |
| (N20)NGG | 19 | 17945962 | + | TGGCTCGGGAGGGGGCTGATGGG | 3 | | 2 | 41 SEQ ID NO. 1670 |
| (N20)NGG | 19 | 17945994 | + | TTCATCAAGCTGAGTGACCCTGG | 1 | | 5 | 37 SEQ ID NO. 1671 |
| (N20)NGG | 19 | 17945995 | + | TCATCAAGCTGAGTGACCCTGGG | 1 | | 4 | 59 SEQ ID NO. 1672 |
| (N20)NGG | 19 | 17945996 | + | CATCAAGCTGAGTGACCCTGGGG | 1 | | 8 | 61 SEQ ID NO. 1673 |
| (N20)NGG | 19 | 17946020 | + | CAGCCCGCTGTGTTAAGCCTGG | 1 | | 1 | 11 SEQ ID NO. 1674 |
| (N20)NGG | 19 | 17946035 | + | AAGCCTGGAGAGTAAGTTCCTGG | 1 | | 2 | 32 SEQ ID NO. 1675 |
| (N20)NGG | 19 | 17946038 | + | CCTGGAGAGTAAGTTCCTGGAGG | 2 | | 9 | 56 SEQ ID NO. 1676 |
| (N20)NGG | 19 | 17946041 | + | GGAGAGTAAGTTCCTGGAGGTGG | 1 | | 7 | 79 SEQ ID NO. 1677 |
| (N20)NGG | 19 | 17946044 | + | GAGTAAGTTCCTGGAGGTGGAGG | 3 | | 4 | 90 SEQ ID NO. 1678 |
| (N20)NGG | 19 | 17946047 | + | TAAGTTCCTGGAGGTGGAGGAGG | 1 | | 9 | 103 SEQ ID NO. 1679 |
| (N20)NGG | 19 | 17946048 | + | AAGTTCCTGGAGGTGGAGGAGGG | 2 | | 10 | 150 SEQ ID NO. 1680 |
| (N20)NGG | 19 | 17945871 | - | CTCCTAAGGGGCCAGACACAGG | 1 | | 1 | 23 SEQ ID NO. 1681 |

FIG. 8 cont.

| site_type | site_chr omosome | site_start_ nucleotide | site_s trand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17945882 | - | AGGCCTTGTCTCCTAAGGGG | | 1 | 5 | 27 SEQ ID NO. 1682 |
| (N20)NGG | 19 | 17945883 | - | CAGGCCTTTGTCTCCTAAGGGG | | 1 | 4 | 42 SEQ ID NO. 1683 |
| (N20)NGG | 19 | 17945884 | - | GCAGGCCTTTGTCCTCCTAAGG | | 1 | 3 | 34 SEQ ID NO. 1684 |
| (N20)NGG | 19 | 17945885 | - | GGCAGGCCTTTGTCCTCCTAAGG | | 1 | 1 | 35 SEQ ID NO. 1685 |
| (N20)NGG | 19 | 17945902 | - | CAGAGACATTGCCATGGGCAGG | | 1 | 2 | 74 SEQ ID NO. 1686 |
| (N20)NGG | 19 | 17945906 | - | CGGGCAGAGACATTGCCATGGG | | 1 | 1 | 22 SEQ ID NO. 1687 |
| (N20)NGG | 19 | 17945907 | - | CCGGGCAGAGACATTGCCATGG | | 1 | 1 | 13 SEQ ID NO. 1688 |
| (N20)NGG | 19 | 17945908 | - | TCCGGGCAGAGACATTGCCATGG | | 2 | 3 | 22 SEQ ID NO. 1689 |
| (N20)NGG | 19 | 17945925 | - | CCGAGCCAGGAGCACCTTCCGG | | 2 | 3 | 29 SEQ ID NO. 1690 |
| (N20)NGG | 19 | 17945926 | - | CCCGAGCCAGGAGCACCTTCGG | | 1 | 3 | 26 SEQ ID NO. 1691 |
| (N20)NGG | 19 | 17945938 | - | CATCAGCCCCCTCCCGAGCCAGG | | 1 | 5 | 56 SEQ ID NO. 1692 |
| (N20)NGG | 19 | 17945965 | - | CACTCAGCTTGATGAAGGGCGG | | 1 | 4 | 36 SEQ ID NO. 1693 |
| (N20)NGG | 19 | 17945966 | - | TCACTCAGCTTGATGAAGGGCGG | | 1 | 3 | 36 SEQ ID NO. 1694 |
| (N20)NGG | 19 | 17945969 | - | GGGTCACTCAGCTTGATGAAGG | | 3 | 3 | 19 SEQ ID NO. 1695 |
| (N20)NGG | 19 | 17945970 | - | AGGGTCACTCAGCTTGATGAAGG | | 2 | 4 | 44 SEQ ID NO. 1696 |
| (N20)NGG | 19 | 17945989 | - | ACACAGCGGGGCTGACCCCAGG | | 1 | 2 | 31 SEQ ID NO. 1697 |
| (N20)NGG | 19 | 17945990 | - | AACACAGCGGGGCTGACCCCAGG | | 1 | 2 | 18 SEQ ID NO. 1698 |
| (N20)NGG | 19 | 17946001 | - | TCTCCAGGCTTAACACAGCGGGG | | 1 | 1 | 24 SEQ ID NO. 1699 |
| (N20)NGG | 19 | 17946002 | - | CTCTCCAGGCTTAACACAGCGGG | | 1 | 3 | 26 SEQ ID NO. 1700 |
| (N20)NGG | 19 | 17946003 | - | ACTCTCCAGGCTTAACACAGCGG | | 1 | 3 | 46 SEQ ID NO. 1701 |
| (N20)NGG | 19 | 17946016 | - | CCTCCAGGAACTTACTCTCCAGG | | 2 | 7 | 64 SEQ ID NO. 1702 |
| (N20)NGG | 19 | 17946732 | + | GCCTCTCCCTGCTGCCAACCAGG | | 1 | 8 | 88 SEQ ID NO. 1703 |
| (N20)NGG | 19 | 17946740 | + | CTGCTGCCAACCAGGCACCATGG | | 1 | 8 | 71 SEQ ID NO. 1704 |
| (N20)NGG | 19 | 17946746 | + | CCAACCAGGCACCATGGTGCAGG | | 1 | 5 | 43 SEQ ID NO. 1705 |
| (N20)NGG | 19 | 17946761 | + | GGTGCAGGAATTTGTACACCTGG | | 1 | 2 | 22 SEQ ID NO. 1706 |
| (N20)NGG | 19 | 17946762 | + | GTGCAGGAATTTGTACACCTGGG | | 1 | 1 | 28 SEQ ID NO. 1707 |
| (N20)NGG | 19 | 17946763 | + | TGCAGGAATTTGTACACCTGGGG | | 1 | 2 | 33 SEQ ID NO. 1708 |
| (N20)NGG | 19 | 17946764 | + | GCAGGAATTTGTACACCTGGGGG | | 1 | 2 | 26 SEQ ID NO. 1709 |
| (N20)NGG | 19 | 17946792 | + | GACATGTATCTGCGAAAACGTGG | | 1 | 1 | 8 SEQ ID NO. 1710 |
| (N20)NGG | 19 | 17946800 | + | TCTGCGAAAACGTGGCCACCTGG | | 1 | 1 | 9 SEQ ID NO. 1711 |
| (N20)NGG | 19 | 17946814 | + | GCCACCTGGTGCCAGCCAGCTGG | | 1 | 7 | 83 SEQ ID NO. 1712 |
| (N20)NGG | 19 | 17946824 | + | GCCAGCTGGAAGCTGCAGG | | 2 | 7 | 88 SEQ ID NO. 1713 |
| (N20)NGG | 19 | 17946827 | + | AGCCACCTGGAAGCTGCAGGTGG | | 1 | 9 | 117 SEQ ID NO. 1714 |

FIG. 8 cont.

| site type | site chromosome | site start nucleotide | site strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 19 | 17946839 | + | GCTGCAGGTGGTCAAACAGCTGG | 1 | 6 | 63 | SEQ ID NO. | 1715 |
| (N20)NGG | 19 | 17946860 | + | GGCCTACGCCCTCAACTATCTGG | 1 | 1 | 4 | SEQ ID NO. | 1716 |
| (N20)NGG | 19 | 17946707 | - | GGTTGGCAGCAGGAGAGGCGGG | 1 | 17 | 229 | SEQ ID NO. | 1717 |
| (N20)NGG | 19 | 17946708 | - | TGGTTGGCAGCAGGAGAGGCGG | 1 | 27 | 393 | SEQ ID NO. | 1718 |
| (N20)NGG | 19 | 17946711 | - | GCCTGGTTGGCAGCAGGAGAGG | 1 | 14 | 135 | SEQ ID NO. | 1719 |
| (N20)NGG | 19 | 17946716 | - | ATGGTGCCTGGTTGGCAGCAGG | 1 | 2 | 48 | SEQ ID NO. | 1720 |
| (N20)NGG | 19 | 17946717 | - | CATGGTGCCTGGTTGGCAGCAG | 1 | 5 | 66 | SEQ ID NO. | 1721 |
| (N20)NGG | 19 | 17946724 | - | CCTGCACCATGGTGCCTGGTTGG | 1 | 5 | 83 | SEQ ID NO. | 1722 |
| (N20)NGG | 19 | 17946728 | - | AATTCCTGCACCATGTGCCTGG | 1 | 2 | 26 | SEQ ID NO. | 1723 |
| (N20)NGG | 19 | 17946735 | - | GTGTACAAATTCCTGCACCATGG | 1 | 1 | 32 | SEQ ID NO. | 1724 |
| (N20)NGG | 19 | 17946757 | - | GATACATGTCTATGGCCCCCAGG | 1 | 3 | 18 | SEQ ID NO. | 1725 |
| (N20)NGG | 19 | 17946765 | - | TTTTCGCAGATACATGTCTATGG | 1 | 2 | 18 | SEQ ID NO. | 1726 |
| (N20)NGG | 19 | 17946793 | - | TCCAGCTGGCTGCGCACCAGTGG | 1 | 5 | 80 | SEQ ID NO. | 1727 |
| (N20)NGG | 19 | 17946796 | - | GCTTCCAGCTGGCTGCCACCAGG | 1 | 5 | 88 | SEQ ID NO. | 1728 |
| (N20)NGG | 19 | 17946803 | - | ACCTGCAGCTTCCAGCTGGCTGG | 1 | 3 | 63 | SEQ ID NO. | 1729 |
| (N20)NGG | 19 | 17946807 | - | GACCACCTGCAGCTTCCAGCTGG | 1 | 4 | 56 | SEQ ID NO. | 1730 |
| (N20)NGG | 19 | 17946840 | - | CACCAGATAGTTGAGGGCGTAGG | 1 | 1 | 12 | SEQ ID NO. | 1731 |
| (N20)NGG | 19 | 17946846 | - | AGCACTCACCAGATAGTTGAGGG | 1 | 3 | 35 | SEQ ID NO. | 1732 |
| (N20)NGG | 19 | 17946847 | - | GAGCACTCACCAGATAGTTGAGG | 1 | 1 | 26 | SEQ ID NO. | 1733 |
| (N20)NGG | 19 | 17947946 | + | CCACCTTCCCCAGTCATTCCTGG | 1 | 9 | 117 | SEQ ID NO. | 1734 |
| (N20)NGG | 19 | 17947981 | + | TGATGAGCCAAGTGTCGTACCGG | 1 | 1 | 12 | SEQ ID NO. | 1735 |
| (N20)NGG | 19 | 17948001 | + | CGGCATCTCGTCGTCCACGG | 1 | 2 | 13 | SEQ ID NO. | 1736 |
| (N20)NGG | 19 | 17948012 | + | GCTGCTCCACGGCGTGTGCATGG | 1 | 1 | 20 | SEQ ID NO. | 1737 |
| (N20)NGG | 19 | 17948016 | + | CTCCACGGCGTGTGCATGGCTGG | 1 | 2 | 12 | SEQ ID NO. | 1738 |
| (N20)NGG | 19 | 17947918 | - | ATGACTGGGGAAGGTGGGAAGGG | 2 | 9 | 149 | SEQ ID NO. | 1739 |
| (N20)NGG | 19 | 17947919 | - | AATGACTGGGGAAGGTGGGAAGG | 1 | 9 | 154 | SEQ ID NO. | 1740 |
| (N20)NGG | 19 | 17947923 | - | CAGGAATGACTGGGGAAGGTGGG | 1 | 11 | 118 | SEQ ID NO. | 1741 |
| (N20)NGG | 19 | 17947924 | - | CCAGGAATGACTGGGGAAGGTGG | 2 | 12 | 157 | SEQ ID NO. | 1742 |
| (N20)NGG | 19 | 17947927 | - | CTTCCAGGAATGACTGGGGAAGG | 2 | 7 | 86 | SEQ ID NO. | 1743 |
| (N20)NGG | 19 | 17947931 | - | GCTGCTTCCAGGAATGACTGGGG | 1 | 10 | 75 | SEQ ID NO. | 1744 |
| (N20)NGG | 19 | 17947932 | - | CGCTGCTTCCAGGAATGACTGGG | 1 | 2 | 27 | SEQ ID NO. | 1745 |
| (N20)NGG | 19 | 17947933 | - | TCGCTGCTTCCAGGAATGACTGG | 1 | 3 | 24 | SEQ ID NO. | 1746 |
| (N20)NGG | 19 | 17947942 | - | TCATCAAGCTCGCTGCTTCCAGG | 1 | 4 | 23 | SEQ ID NO. | 1747 |

FIG. 8 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17947966 | - | CGAGATGCCGGTACGACACTTGG | | 1 | 3 | SEQ ID NO. 1748 |
| (N20)NGG | 19 | 17947978 | - | CGTGGAGCAGCACGAGATGCCGG | 1 | 2 | 16 | SEQ ID NO. 1749 |
| (N20)NGG | 19 | 17947996 | - | CTCCAGCCATGCACACGCCGTGG | 1 | 3 | 26 | SEQ ID NO. 1750 |
| (N20)NGG | 19 | 17948752 | + | CACCATTCAGCATGAGAACCTGG | 1 | 2 | 23 | SEQ ID NO. 1751 |
| (N20)NGG | 19 | 17948753 | + | ACCATTCAGCATGAGAACCTGGG | 1 | 2 | 30 | SEQ ID NO. 1752 |
| (N20)NGG | 19 | 17948759 | + | CAGCATGAGAACCTGGGCCATGG | 1 | 4 | 58 | SEQ ID NO. 1753 |
| (N20)NGG | 19 | 17948760 | + | AGCATGAGAACCTGGGCCATGGG | 1 | 3 | 36 | SEQ ID NO. 1754 |
| (N20)NGG | 19 | 17948781 | + | GGTCCTTCACCAAGATTTACCGG | 1 | 2 | 23 | SEQ ID NO. 1755 |
| (N20)NGG | 19 | 17948782 | + | GTCCTTCACCAAGATTTACCGGG | 1 | 2 | 32 | SEQ ID NO. 1756 |
| (N20)NGG | 19 | 17948783 | + | TCCTTCACCAAGATTTACCGGGG | 1 | 1 | 16 | SEQ ID NO. 1757 |
| (N20)NGG | 19 | 17948797 | + | TTACCGGGCTGTCGCCATGAGG | 1 | 1 | 5 | SEQ ID NO. 1758 |
| (N20)NGG | 19 | 17948800 | + | CCGGGCTGTCGCCATGAGGTGG | 1 | 3 | 21 | SEQ ID NO. 1759 |
| (N20)NGG | 19 | 17948803 | + | GGGCTGTCGCCATGAGGTGGTGG | 1 | 3 | 38 | SEQ ID NO. 1760 |
| (N20)NGG | 19 | 17948807 | + | TGTCGCCATGAGGTGGTGGATGG | 1 | 1 | 19 | SEQ ID NO. 1761 |
| (N20)NGG | 19 | 17948808 | + | GTCGCCATGAGGTGGTGGATGGG | 1 | 1 | 13 | SEQ ID NO. 1762 |
| (N20)NGG | 19 | 17948809 | + | TCGCCATGAGGTGGTGGATGGGG | 1 | 2 | 25 | SEQ ID NO. 1763 |
| (N20)NGG | 19 | 17948812 | + | CCATGAGGTGGTGGATGGGGAGG | 2 | 14 | 159 | SEQ ID NO. 1764 |
| (N20)NGG | 19 | 17948827 | + | TGGGGAGGCCCGAAAGACAGAGG | 1 | 3 | 36 | SEQ ID NO. 1765 |
| (N20)NGG | 19 | 17948839 | + | AAAGACAGAGGTGCTGCTGAAGG | 1 | 5 | 101 | SEQ ID NO. 1766 |
| (N20)NGG | 19 | 17948845 | + | AGAGGTGCTGCTGAAGTCATGG | 1 | 7 | 105 | SEQ ID NO. 1767 |
| (N20)NGG | 19 | 17948869 | + | TGCAAGCACAAGAACTGCATGG | 1 | 3 | 52 | SEQ ID NO. 1768 |
| (N20)NGG | 19 | 17948872 | + | CAAGCACAAGAACTGCATGGAGG | 1 | 26 | 858 | SEQ ID NO. 1769 |
| (N20)NGG | 19 | 17948886 | + | GCATGAGGTGAGAGCAATGTGG | 1 | 3 | 66 | SEQ ID NO. 1770 |
| (N20)NGG | 19 | 17948725 | - | TTCTCATGCTGAATGGTGAGGGG | 2 | 4 | 48 | SEQ ID NO. 1771 |
| (N20)NGG | 19 | 17948726 | - | GTTCTCATGCTGAATGGTGAGG | 1 | 8 | 52 | SEQ ID NO. 1772 |
| (N20)NGG | 19 | 17948727 | - | GGTTCTCATGCTGAATGGTGAGG | 1 | 5 | 36 | SEQ ID NO. 1773 |
| (N20)NGG | 19 | 17948732 | - | GCCCAGTTTCTCATGCTGAATGG | 1 | 1 | 35 | SEQ ID NO. 1774 |
| (N20)NGG | 19 | 17948748 | - | TGGTGAAGGACCCATGGCCCAGG | 1 | 1 | 41 | SEQ ID NO. 1775 |
| (N20)NGG | 19 | 17948754 | - | AAATCTTGGTGAAGGACCCATGG | 1 | 5 | 45 | SEQ ID NO. 1776 |
| (N20)NGG | 19 | 17948762 | - | GCCCCGGTAAATCTTGGTGAAGG | 1 | 1 | 8 | SEQ ID NO. 1777 |
| (N20)NGG | 19 | 17948768 | - | GCGACAGCCCGGTAAATCTTGG | 1 | 1 | 6 | SEQ ID NO. 1778 |
| (N20)NGG | 19 | 17948778 | - | CCACCTCATGGCGACAGCCCGG | 1 | 2 | 31 | SEQ ID NO. 1779 |
| (N20)NGG | 19 | 17948790 | - | CCTCCCCATCCACCACCTCATGG | 5 | 17 | 178 | SEQ ID NO. 1780 |

FIG. 8 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17948813 | - | CAGCAGCACCTCTGTCTTTCGGG | 1 | 6 | 85 | SEQ ID NO. 1781 |
| (N20)NGG | 19 | 17948814 | - | TCAGCAGCACCTCTGTCTTTCGG |  | 5 | 70 | SEQ ID NO. 1782 |
| (N20)NGG | 19 | 17948849 | - | CTCCATGCAGTTCTTGTGCTTGG | 1 | 12 | 406 | SEQ ID NO. 1783 |
| (N20)NGG | 19 | 17949091 | + | AGAAAAGTCCAACCTGATCGTGG | 1 | 1 | 20 | SEQ ID NO. 1784 |
| (N20)NGG | 19 | 17949101 | + | AACCTGATCGTGGTCCAGAGAGG | 1 | 1 | 6 | SEQ ID NO. 1785 |
| (N20)NGG | 19 | 17949127 | + | CAGCCCACCCACATCATCCTTGG | 1 | 8 | 83 | SEQ ID NO. 1786 |
| (N20)NGG | 19 | 17949193 | + | CAAGATCCCTGCTGACAGCCTGG | 1 | 2 | 54 | SEQ ID NO. 1787 |
| (N20)NGG | 19 | 17949198 | + | TCCCTGCTGACAGCCTGGAGTGG | 1 | 8 | 92 | SEQ ID NO. 1788 |
| (N20)NGG | 19 | 17949199 | + | CCCTGCTGACAGCCTGGAGTGGG | 1 | 8 | 92 | SEQ ID NO. 1789 |
| (N20)NGG | 19 | 17949206 | + | GACAGCCTGGAGTGGGTAAGAGG | 1 | 4 | 56 | SEQ ID NO. 1790 |
| (N20)NGG | 19 | 17949212 | + | CTGGAGTGGGTAAGAGGCCCTGG | 1 | 3 | 58 | SEQ ID NO. 1791 |
| (N20)NGG | 19 | 17949213 | + | TGGAGTGGGTAAGAGGCCCTGGG | 2 | 4 | 45 | SEQ ID NO. 1792 |
| (N20)NGG | 19 | 17949221 | + | GTAAGAGGCCCTGGAAATGAGG | 1 | 8 | 122 | SEQ ID NO. 1793 |
| (N20)NGG | 19 | 17949051 | - | TTTTCTATGGGGAGAGGATGAGG | 1 | 12 | 105 | SEQ ID NO. 1794 |
| (N20)NGG | 19 | 17949052 | - | TTTTTCTATGGGGAGAGGATGGG | 2 | 9 | 112 | SEQ ID NO. 1795 |
| (N20)NGG | 19 | 17949058 | - | TTGGACTTTTCTATGGGGAGAGG | 1 | 4 | 44 | SEQ ID NO. 1796 |
| (N20)NGG | 19 | 17949063 | - | TCAGGTTGGACTTTTCTATGGGG | 1 | 3 | 31 | SEQ ID NO. 1797 |
| (N20)NGG | 19 | 17949064 | - | ATCAGGTTGGACTTTTCTATGGG | 2 | 2 | 30 | SEQ ID NO. 1798 |
| (N20)NGG | 19 | 17949065 | - | GATCAGGTTGGACTTTTCTATGG | 1 | 5 | 40 | SEQ ID NO. 1799 |
| (N20)NGG | 19 | 17949077 | - | TCTCTGGACCACGATCAGGTTGG | 1 | 1 | 8 | SEQ ID NO. 1800 |
| (N20)NGG | 19 | 17949081 | - | GACCTCTGGACCACGATCAGG | 1 | 1 | 5 | SEQ ID NO. 1801 |
| (N20)NGG | 19 | 17949093 | - | TGGGTGGGCTGTGACCTCTCTGG | 1 | 5 | 54 | SEQ ID NO. 1802 |
| (N20)NGG | 19 | 17949108 | - | GAACCAAGGATGATGTGGGTGGG | 1 | 3 | 40 | SEQ ID NO. 1803 |
| (N20)NGG | 19 | 17949109 | - | TGAACCAAGGATGATGTGGGTGG | 1 | 2 | 45 | SEQ ID NO. 1804 |
| (N20)NGG | 19 | 17949112 | - | GGCTGAACCAAGGATGATGTCGG | 1 | 2 | 27 | SEQ ID NO. 1805 |
| (N20)NGG | 19 | 17949113 | - | GGGCTGAACCAAGGATGATGTGG | 1 | 2 | 43 | SEQ ID NO. 1806 |
| (N20)NGG | 19 | 17949122 | - | TTGGATTGGGGCTGAACCAAGG | 1 | 1 | 34 | SEQ ID NO. 1807 |
| (N20)NGG | 19 | 17949133 | - | CTCAGCTGGTATTGGGATTGGG | 1 | 2 | 33 | SEQ ID NO. 1808 |
| (N20)NGG | 19 | 17949134 | - | ACTCAGCTGGTATTGGGATTGG | 1 | 2 | 30 | SEQ ID NO. 1809 |
| (N20)NGG | 19 | 17949135 | - | GACTCAGCTGGTATTGGGATTGG | 1 | 3 | 19 | SEQ ID NO. 1810 |
| (N20)NGG | 19 | 17949140 | - | CATCTGACTCAGCTGGTATTGGG | 1 | 2 | 29 | SEQ ID NO. 1811 |
| (N20)NGG | 19 | 17949141 | - | TCATCTGACTCAGCTGGTATTGG | 1 | 1 | 25 | SEQ ID NO. 1812 |
| (N20)NGG | 19 | 17949147 | - | GAAATGTCATCTGACTCAGCTGG | 1 | 4 | 172 | SEQ ID NO. 1813 |

FIG. 8 cont.

| site type | site_chr omosome | site_start_ nucleotide | site_s trand | target_site_sequence_wit h_NGG | genome_wide_ hits_with_1 or_less_mism atches | genome_wide_ hits_with_ 2_or_less_m ismatches | genome_wide_ hits_with_3 or_less_mism atches | | |
|---|---|---|---|---|---|---|---|---|---|
| (N20)NGG | 19 | 17949177 | - | CCCACTCCAGGCTGTCAGCAGGG | | 1 | 9 | 108 | SEQ ID NO. 1814 |
| (N20)NGG | 19 | 17949178 | - | ACCCACTCCAGGCTGTCAGCAGG | | 1 | 9 | 61 | SEQ ID NO. 1815 |
| (N20)NGG | 19 | 17949189 | - | CAGGGCCTCTTACCACTCCAGG | | 1 | 4 | 54 | SEQ ID NO. 1816 |
| (N20)NGG | 19 | 17950295 | + | TCTTCTTTGCAGAACCCCCTTGG | | 1 | 4 | 45 | SEQ ID NO. 1817 |
| (N20)NGG | 19 | 17950309 | + | CCCCTTGGTCCTGATTATAAGG | | 1 | 2 | 19 | SEQ ID NO. 1818 |
| (N20)NGG | 19 | 17950310 | + | CCCCTTGGTCCTGATTATAAGGG | | 1 | 3 | 38 | SEQ ID NO. 1819 |
| (N20)NGG | 19 | 17950323 | + | ATTATAAGGGCTGCCTCATCCGG | | 1 | 4 | 23 | SEQ ID NO. 1820 |
| (N20)NGG | 19 | 17950337 | + | CTCATCCGGCGCAGCCCCACAGG | | 1 | 1 | 15 | SEQ ID NO. 1821 |
| (N20)NGG | 19 | 17950351 | + | CCCCACAGGAACCTTCCTTCTGG | | 1 | 8 | 59 | SEQ ID NO. 1822 |
| (N20)NGG | 19 | 17950355 | + | ACAGGAACCTTCCTTCTGGTTGG | | 1 | 3 | 37 | SEQ ID NO. 1823 |
| (N20)NGG | 19 | 17950393 | + | CAGCAGTCTTCGAGAGCTCCTGG | | 1 | 5 | 27 | SEQ ID NO. 1824 |
| (N20)NGG | 19 | 17950404 | + | GAGAGCTCCTGGCAACCTGCTGG | | 2 | 7 | 66 | SEQ ID NO. 1825 |
| (N20)NGG | 19 | 17950405 | + | AGAGCTCCTGGCAACCTGCTGGG | | 1 | 2 | 41 | SEQ ID NO. 1826 |
| (N20)NGG | 19 | 17950409 | + | CTCCTGGCAACCTGCTGGGATGG | | 1 | 4 | 58 | SEQ ID NO. 1827 |
| (N20)NGG | 19 | 17950410 | + | TCCTGGCAACCTGCTGGGATGGG | | 1 | 1 | 49 | SEQ ID NO. 1828 |
| (N20)NGG | 19 | 17950411 | + | CCTGGCAACCTGCTGGGATGGGG | | 1 | 3 | 57 | SEQ ID NO. 1829 |
| (N20)NGG | 19 | 17950412 | + | CTGGCAACCTGCTGGGATGGGGG | | 1 | 4 | 56 | SEQ ID NO. 1830 |
| (N20)NGG | 19 | 17950413 | + | TGGCAACCTGCTGGGATGGGGGG | | 1 | 3 | 58 | SEQ ID NO. 1831 |
| (N20)NGG | 19 | 17950427 | + | GATGGGGGGCTGCACGTAGATGG | | 1 | 5 | 18 | SEQ ID NO. 1832 |
| (N20)NGG | 19 | 17950428 | + | ATGGGGGGCTGCACGTAGATGGG | | 1 | 1 | 6 | SEQ ID NO. 1833 |
| (N20)NGG | 19 | 17950429 | + | TGGGGGGCTGCACGTAGATGGGG | | 1 | 1 | 24 | SEQ ID NO. 1834 |
| (N20)NGG | 19 | 17950432 | + | GGGGCTGCACGTAGATGGGGTGG | | 1 | 6 | 41 | SEQ ID NO. 1835 |
| (N20)NGG | 19 | 17950472 | + | TGCTGTATCCCAGACCCAAAGG | | 1 | 9 | 97 | SEQ ID NO. 1836 |
| (N20)NGG | 19 | 17950492 | + | AGGTGAGCCCCTTCCTCCCCTGG | | 2 | 6 | 93 | SEQ ID NO. 1837 |
| (N20)NGG | 19 | 17950269 | - | CCCTGGGGTTCTGCAAAGAAGAGTGG | | 1 | 4 | 75 | SEQ ID NO. 1838 |
| (N20)NGG | 19 | 17950287 | - | CCTTATAATCAGGACCAAGGGGG | | 1 | 3 | 56 | SEQ ID NO. 1839 |
| (N20)NGG | 19 | 17950288 | - | CCCTTATAATCAGGACCAAGGG | | 1 | 3 | 28 | SEQ ID NO. 1840 |
| (N20)NGG | 19 | 17950289 | - | GCCCTTATAATCAGGACCAAGG | | 1 | 1 | 34 | SEQ ID NO. 1841 |
| (N20)NGG | 19 | 17950290 | - | AGCCCTTATAATCAGGACCAAG | | 1 | 2 | 18 | SEQ ID NO. 1842 |
| (N20)NGG | 19 | 17950297 | - | ATGAGGCAGCCCTTATAATCAGG | | 1 | 2 | 19 | SEQ ID NO. 1843 |
| (N20)NGG | 19 | 17950314 | - | CTGTGGGGCTGCGCCGGATGAGG | | 1 | 4 | 27 | SEQ ID NO. 1844 |
| (N20)NGG | 19 | 17950320 | - | AGGTTCCTGTGGGGCTGCGCCGG | | 1 | 5 | 44 | SEQ ID NO. 1845 |
| (N20)NGG | 19 | 17950329 | - | CCAGAAGGAAGTTCCTGTGGGG | | 1 | 3 | 70 | SEQ ID NO. 1846 |

FIG. 8 cont.

| site type | site chromosome | site start nucleotide | site strand | target site sequence with NGG | genome wide hits with 1 or less mismatches | genome wide hits with 2 or less mismatches | genome wide hits with 3 or less mismatches | | |
|---|---|---|---|---|---|---|---|---|---|
| (N20)NGG | 19 | 17950330 | - | ACCAGAAGGAAGGTTCCTGTGG | 1 | 3 | 50 | SEQ ID NO. | 1847 |
| (N20)NGG | 19 | 17950331 | - | AACCAGAAGGAAGGTTCCTGTGG | 1 | 5 | 83 | SEQ ID NO. | 1848 |
| (N20)NGG | 19 | 17950340 | - | GCTGAGGCCAACCAGAAGGAAGG | 1 | 2 | 60 | SEQ ID NO. | 1849 |
| (N20)NGG | 19 | 17950344 | - | GTCGGCTGAGGCCAACCAGAAGG | 1 | 1 | 16 | SEQ ID NO. | 1850 |
| (N20)NGG | 19 | 17950356 | - | GACTGCTGTGGGGTCGGCTGAGG | 1 | 11 | 462 | SEQ ID NO. | 1851 |
| (N20)NGG | 19 | 17950362 | - | CTGAAGACTGCTGTGGGGTCGG | 1 | 2 | 25 | SEQ ID NO. | 1852 |
| (N20)NGG | 19 | 17950366 | - | AGCTCTCGAAGACTGCTGTGGGG | 1 | 3 | 21 | SEQ ID NO. | 1853 |
| (N20)NGG | 19 | 17950367 | - | GAGCTCTCGAAGACTGCTGTGGG | 1 | 2 | 26 | SEQ ID NO. | 1854 |
| (N20)NGG | 19 | 17950368 | - | GGAGCTCTCGAAGACTGCTGTGG | 1 | 3 | 31 | SEQ ID NO. | 1855 |
| (N20)NGG | 19 | 17950389 | - | CCCCATCCAGCAGGTTGCCAGG | 1 | 2 | 68 | SEQ ID NO. | 1856 |
| (N20)NGG | 19 | 17950397 | - | GTGCAGCCCCCATCCAGCAGG | 2 | 6 | 62 | SEQ ID NO. | 1857 |
| (N20)NGG | 19 | 17950439 | - | GGGGATACAGCAGGAAGTGAGG | 3 | 16 | 147 | SEQ ID NO. | 1858 |
| (N20)NGG | 19 | 17950440 | - | TGGGGATACAGCAGGAAGTGAGG | 2 | 22 | 135 | SEQ ID NO. | 1859 |
| (N20)NGG | 19 | 17950448 | - | TTTGGGTCTGGGGATACAGCAGG | 1 | 1 | 76 | SEQ ID NO. | 1860 |
| (N20)NGG | 19 | 17950458 | - | GGGGCTCACCTTTGGGTCTGGG | 1 | 3 | 51 | SEQ ID NO. | 1861 |
| (N20)NGG | 19 | 17950459 | - | AGGGGCTCACCTTTGGGTCTGG | 1 | 3 | 37 | SEQ ID NO. | 1862 |
| (N20)NGG | 19 | 17950460 | - | AAGGGGCTCACCTTTGGGTCTG | 1 | 3 | 14 | SEQ ID NO. | 1863 |
| (N20)NGG | 19 | 17950465 | - | GGAGGAAGGGGCTCACCTTTGG | 1 | 8 | 53 | SEQ ID NO. | 1864 |
| (N20)NGG | 19 | 17950466 | - | GGGAGGAAGGGGCTCACCTTTG | 1 | 5 | 64 | SEQ ID NO. | 1865 |
| (N20)NGG | 19 | 17951042 | + | TCTCACCTTCCCCACAGTCTGG | 1 | 5 | 72 | SEQ ID NO. | 1866 |
| (N20)NGG | 19 | 17951070 | + | GCCATCAACAAGCTCAAGACTGG | 1 | 3 | 33 | SEQ ID NO. | 1867 |
| (N20)NGG | 19 | 17951071 | + | CCATCAACAAGCTCAAGACTGGG | 1 | 5 | 52 | SEQ ID NO. | 1868 |
| (N20)NGG | 19 | 17951072 | + | CATCAACAAGCTCAAGACTGGGG | 1 | 4 | 42 | SEQ ID NO. | 1869 |
| (N20)NGG | 19 | 17951073 | + | ATCAACAAGCTCAAGACTGGGGG | 1 | 3 | 35 | SEQ ID NO. | 1870 |
| (N20)NGG | 19 | 17951085 | + | AAGACTGGGGCTCACGTCCTGG | 1 | 1 | 19 | SEQ ID NO. | 1871 |
| (N20)NGG | 19 | 17951114 | + | TGTTCTCCGCCGCAGCCCCCAGG | 1 | 4 | 26 | SEQ ID NO. | 1872 |
| (N20)NGG | 19 | 17951150 | + | CCTCCTCACTGTCTGTGTCCAGG | 1 | 8 | 102 | SEQ ID NO. | 1873 |
| (N20)NGG | 19 | 17951154 | + | CTCACTGTCTGTGTCCAGGTCGG | 3 | 8 | 76 | SEQ ID NO. | 1874 |
| (N20)NGG | 19 | 17951166 | + | GTCCAGGTCGGTCTACTGCTAGG | 1 | 2 | 10 | SEQ ID NO. | 1875 |
| (N20)NGG | 19 | 17951167 | + | TCCAGGTCGGTCTACTGCTAGG | 1 | 2 | 13 | SEQ ID NO. | 1876 |
| (N20)NGG | 19 | 17951170 | + | AGGTCGGTCTACTGCTAGGGTGG | 1 | 1 | 6 | SEQ ID NO. | 1877 |
| (N20)NGG | 19 | 17951171 | + | GGTCGGTCTACTGCTAGGGTGGG | 1 | 1 | 3 | SEQ ID NO. | 1878 |
| (N20)NGG | 19 | 17951017 | - | GACTGTGGGGAAGGTGAGAGGG | 1 | 8 | 176 | SEQ ID NO. | 1879 |

FIG. 8 cont.

| site_type | site_chr omosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17951018 | - | AGACTGTGGGGAAGGTGAGAGG | 1 | 12 | 195 | SEQ ID NO. 1880 |
| (N20)NGG | 19 | 17951025 | - | AAAGTCCAGACTGTGGGGAAGG | 2 | 5 | 65 | SEQ ID NO. 1881 |
| (N20)NGG | 19 | 17951029 | - | TGGCAAAGTCCAGACTGTGGGG | 1 | 7 | 80 | SEQ ID NO. 1882 |
| (N20)NGG | 19 | 17951030 | - | ATGGCAAAGTCCAGACTGTGGG | 1 | 3 | 54 | SEQ ID NO. 1883 |
| (N20)NGG | 19 | 17951031 | - | GATGGCAAAGTCCAGACTGTGG | 1 | 6 | 52 | SEQ ID NO. 1884 |
| (N20)NGG | 19 | 17951032 | - | TGATGGCAAAGTCCAGACTGTGG | 1 | 11 | 64 | SEQ ID NO. 1885 |
| (N20)NGG | 19 | 17951049 | - | CCCAGTCTTGAGCTTGTTGATGG | 1 | 2 | 30 | SEQ ID NO. 1886 |
| (N20)NGG | 19 | 17951081 | - | CGGCCGAGAACATAGGAGCCAGG | 1 | 1 | 6 | SEQ ID NO. 1887 |
| (N20)NGG | 19 | 17951088 | - | GGGGCTGCGCGCGAGAACATAGG | 1 | 1 | 15 | SEQ ID NO. 1888 |
| (N20)NGG | 19 | 17951098 | - | CAAAGTCCTGGGGGCTGCGGCGG | 1 | 8 | 72 | SEQ ID NO. 1889 |
| (N20)NGG | 19 | 17951101 | - | TGTCAAAGTCCTGGGGCTGCGG | 1 | 10 | 141 | SEQ ID NO. 1890 |
| (N20)NGG | 19 | 17951107 | - | GGAAGTCGTCAAAGTCCTGGGG | 1 | 9 | 85 | SEQ ID NO. 1891 |
| (N20)NGG | 19 | 17951108 | - | AGGAAGTCGTCAAAGTCCTGGG | 1 | 5 | 81 | SEQ ID NO. 1892 |
| (N20)NGG | 19 | 17951109 | - | GAGGAAGTCGTCAAAGTCCTGG | 1 | 2 | 57 | SEQ ID NO. 1893 |
| (N20)NGG | 19 | 17951110 | - | GGAGGAAGTCGTCAAAGTCCTG | 1 | 1 | 49 | SEQ ID NO. 1894 |
| (N20)NGG | 19 | 17951128 | - | CCTGGACACAGACAGTGAGGAGG | 1 | 6 | 106 | SEQ ID NO. 1895 |
| (N20)NGG | 19 | 17951131 | - | CGACCTGGACACAGACCGACCTGG | 1 | 3 | 26 | SEQ ID NO. 1896 |
| (N20)NGG | 19 | 17951146 | - | ACCCTAGCAGTAGACCGACCTGG | 1 | 1 | 6 | SEQ ID NO. 1897 |
| (N20)NGG | 19 | 17952197 | + | CTCTGACGCTTGTCCCTGCAGG | 1 | 1 | 10 | SEQ ID NO. 1898 |
| (N20)NGG | 19 | 17952200 | + | TGACGCTTGTCCCTGCAGGAGG | 1 | 1 | 6 | SEQ ID NO. 1899 |
| (N20)NGG | 19 | 17952213 | + | TCCAGGAGGCCGAGTTCCCAGG | 1 | 1 | 16 | SEQ ID NO. 1900 |
| (N20)NGG | 19 | 17952214 | + | CCGAGGAGGCCGAGTTCCCAGG | 1 | 4 | 28 | SEQ ID NO. 1901 |
| (N20)NGG | 19 | 17952224 | + | CGAGTTCCCAGGGCTGCCCAGG | 1 | 2 | 39 | SEQ ID NO. 1902 |
| (N20)NGG | 19 | 17952239 | + | GCCCGAGGCTCTGTCGTTCGTGG | 1 | 1 | 6 | SEQ ID NO. 1903 |
| (N20)NGG | 19 | 17952248 | + | TCTGTCGTTCGTGGCGCTCGTGG | 1 | 1 | 4 | SEQ ID NO. 1904 |
| (N20)NGG | 19 | 17952252 | + | TCGTTCGTGGCGCTCGTGGACGG | 1 | 1 | 6 | SEQ ID NO. 1905 |
| (N20)NGG | 19 | 17952262 | + | CGCTCGTGGACGGCTACTTCCGG | 1 | 1 | 2 | SEQ ID NO. 1906 |
| (N20)NGG | 19 | 17952272 | + | CGGCTACTTCCGGCTGACCACGG | 1 | 1 | 14 | SEQ ID NO. 1907 |
| (N20)NGG | 19 | 17952296 | + | CTCCCAGACACTTCTTCTGCAAGG | 1 | 6 | 100 | SEQ ID NO. 1908 |
| (N20)NGG | 19 | 17952299 | + | CCAGCACTTCTTCTGCAAGGAGG | 1 | 4 | 54 | SEQ ID NO. 1909 |
| (N20)NGG | 19 | 17952302 | + | GCACTTCTTCTGCAAGGAGGTGG | 1 | 4 | 43 | SEQ ID NO. 1910 |
| (N20)NGG | 19 | 17952313 | + | GCAAGGAGGTGGCACCGCCGAGG | 1 | 1 | 19 | SEQ ID NO. 1911 |
| (N20)NGG | 19 | 17952320 | + | GGTGGCACCGCCGAGGCTGCTGG | 1 | 4 | 29 | SEQ ID NO. 1912 |

FIG. 8 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | SEQ ID NO. |
|---|---|---|---|---|---|---|---|---|
| (N20)NGG | 19 | 17952323 | + | GGCACCGCCGAGGCTGCTGGAGG | | 1 | 2 | 49 SEQ ID NO. 1913 |
| (N20)NGG | 19 | 17952329 | + | GCCGAGGCTGCTGGAGGAAGTGG | | 3 | 15 | 162 SEQ ID NO. 1914 |
| (N20)NGG | 19 | 17952345 | + | GAAGTGGCCGAGCAGTGCCACGG | | 1 | 1 | 29 SEQ ID NO. 1915 |
| (N20)NGG | 19 | 17952360 | + | TGCCACGGCCCCATCACGTAAGG | | 1 | 2 | 10 SEQ ID NO. 1916 |
| (N20)NGG | 19 | 17952379 | + | AAGGACCTGTCCCCATTCCCGG | | 1 | 1 | 32 SEQ ID NO. 1917 |
| (N20)NGG | 19 | 17952188 | - | GGGAACTCGGCCTCCTGCGAGGG | | 1 | 1 | 8 SEQ ID NO. 1918 |
| (N20)NGG | 19 | 17952189 | - | TGGGAACTCGGCCTCCTGCGAGG | | 1 | 2 | 22 SEQ ID NO. 1919 |
| (N20)NGG | 19 | 17952201 | - | CTCGGGCAGCCCTGGAACTCGG | | 1 | 3 | 54 SEQ ID NO. 1920 |
| (N20)NGG | 19 | 17952208 | - | ACAGAGCCTCGGGCAGCCCTGGG | | 1 | 8 | 75 SEQ ID NO. 1921 |
| (N20)NGG | 19 | 17952209 | - | GACAGAGCCTCGGGCAGCCCTGG | | 2 | 7 | 70 SEQ ID NO. 1922 |
| (N20)NGG | 19 | 17952218 | - | GCCACGAACGACAGAGCCTCGGG | | 1 | 1 | 21 SEQ ID NO. 1923 |
| (N20)NGG | 19 | 17952219 | - | CGCCACGAACGACAGAGCCTCGG | | 1 | 1 | 9 SEQ ID NO. 1924 |
| (N20)NGG | 19 | 17952259 | - | GCTGGGAGTTCCGTGGTCAGCCGG | | 1 | 2 | 33 SEQ ID NO. 1925 |
| (N20)NGG | 19 | 17952267 | - | GAAGAAGTGCTGGAGAGTCCGTGG | | 1 | 1 | 41 SEQ ID NO. 1926 |
| (N20)NGG | 19 | 17952276 | - | CTCCTTGCAGAAGAAGTGCTGG | | 1 | 5 | 51 SEQ ID NO. 1927 |
| (N20)NGG | 19 | 17952277 | - | CCTCCTTGCAGAAGAAGTGCTGG | | 1 | 3 | 46 SEQ ID NO. 1928 |
| (N20)NGG | 19 | 17952305 | - | ACTTCCTCCAGCAGCCTCGGCGG | | 1 | 4 | 58 SEQ ID NO. 1929 |
| (N20)NGG | 19 | 17952308 | - | GCCACTTCCTCCAGCAGCCTCGG | | 1 | 12 | 123 SEQ ID NO. 1930 |
| (N20)NGG | 19 | 17952330 | - | GATGGGGCCGTGGCACTGCTCGG | | 1 | 2 | 21 SEQ ID NO. 1931 |
| (N20)NGG | 19 | 17952340 | - | GTCCTTACGTGATGGGGCCGTGG | | 1 | 1 | 7 SEQ ID NO. 1932 |
| (N20)NGG | 19 | 17952346 | - | GGACAGGTCCTTACGTGATGGGG | | 1 | 1 | 9 SEQ ID NO. 1933 |
| (N20)NGG | 19 | 17952347 | - | GGGACAGGTCCTTACGTGATGGG | | 1 | 1 | 13 SEQ ID NO. 1934 |
| (N20)NGG | 19 | 17952348 | - | GGGGACAGGTCCTTACGTGATGG | | 1 | 2 | 13 SEQ ID NO. 1935 |
| (N20)NGG | 19 | 17952448 | + | CGGTACTCCCCCTCCTTCCCAGG | | 1 | 3 | 41 SEQ ID NO. 1936 |
| (N20)NGG | 19 | 17952502 | + | CGTAGACATTAGCATCAAGCAGG | | 1 | 1 | 9 SEQ ID NO. 1937 |
| (N20)NGG | 19 | 17952515 | + | ATCAAGCAGGCCCCGCGCGTTGG | | 1 | 2 | 4 SEQ ID NO. 1938 |
| (N20)NGG | 19 | 17952520 | + | GCAGGCCCCGCGCGTTGGCCCGG | | 1 | 2 | 16 SEQ ID NO. 1939 |
| (N20)NGG | 19 | 17952524 | + | GCCCCGCGCGTTGGCCCGGCCGG | | 1 | 2 | 15 SEQ ID NO. 1940 |
| (N20)NGG | 19 | 17952538 | + | CCCGGCCGGAGAGCACCGCCTGG | | 1 | 2 | 30 SEQ ID NO. 1941 |
| (N20)NGG | 19 | 17952552 | + | ACCGCCTGGTCACTGTTACCAGG | | 1 | 1 | 4 SEQ ID NO. 1942 |
| (N20)NGG | 19 | 17952574 | + | GACAGACAACCAGATTTTAGTGG | | 1 | 3 | 47 SEQ ID NO. 1943 |
| (N20)NGG | 19 | 17952575 | + | ACAGACAACCAGATTTTAGTGGG | | 1 | 3 | 37 SEQ ID NO. 1944 |
| (N20)NGG | 19 | 17952581 | + | AACCAGATTTTAGTGGGTGCAGG | | 2 | 3 | 31 SEQ ID NO. 1945 |

FIG. 8 cont.

| site_type | site_chr omosome | site_start_ nucleotide | site_s trand | target_site_sequence_with_NGG | genome_wide_ hits_with_1 or_less_mism atches | genome_wide_ hits_with_2_or_less_m ismatches | genome_wide_ hits_with_3 or_less_mism atches | |
|---|---|---|---|---|---|---|---|---|
| (N20)NGG | 19 | 17952433 | - | TGGAGGACCTGGGAAGGAGGGGG | | 1 | 22 | 279 SEQ ID NO. 1946 |
| (N20)NGG | 19 | 17952434 | - | CTGGAGGACCTGGGAAGGAGGGG | | 2 | 15 | 206 SEQ ID NO. 1947 |
| (N20)NGG | 19 | 17952435 | - | GCTGGAGGACCTGGGAAGGAGGG | | 1 | 7 | 167 SEQ ID NO. 1948 |
| (N20)NGG | 19 | 17952436 | - | GGCTGGAGGACCTGGGAAGGAGG | | 1 | 14 | 219 SEQ ID NO. 1949 |
| (N20)NGG | 19 | 17952439 | - | AAGGGCTGGAGGACCTGGGAAGG | | 2 | 11 | 124 SEQ ID NO. 1950 |
| (N20)NGG | 19 | 17952443 | - | GCAGAAGGGCTGGAGGACCTGGG | | 1 | 6 | 100 SEQ ID NO. 1951 |
| (N20)NGG | 19 | 17952444 | - | CGCAGAAGGGCTGGAGGACCTGG | | 1 | 7 | 57 SEQ ID NO. 1952 |
| (N20)NGG | 19 | 17952450 | - | GAAAGTCGCAGAAGGGCTGGAGG | | 1 | 2 | 35 SEQ ID NO. 1953 |
| (N20)NGG | 19 | 17952453 | - | CTGGAAAGTCGCAGAAGGGCTGG | | 1 | 1 | 26 SEQ ID NO. 1954 |
| (N20)NGG | 19 | 17952457 | - | ATTTCTGAAAGTCGCAGAAGGG | | 1 | 3 | 44 SEQ ID NO. 1955 |
| (N20)NGG | 19 | 17952458 | - | GATTTCTGAAAGTCGCAGAAGG | | 1 | 2 | 37 SEQ ID NO. 1956 |
| (N20)NGG | 19 | 17952472 | - | ATGCTAATGTCTACGATTTCTGG | | 1 | 1 | 16 SEQ ID NO. 1957 |
| (N20)NGG | 19 | 17952503 | - | TCCGGCCGGGCCAACGCGCGGG | | 1 | 1 | 9 SEQ ID NO. 1958 |
| (N20)NGG | 19 | 17952504 | - | CTCCGGCCGGGCCAACGCGCGG | | 1 | 1 | 13 SEQ ID NO. 1959 |
| (N20)NGG | 19 | 17952505 | - | TCTCCGGCCGGGCCAACGCGCG | | 1 | 1 | 11 SEQ ID NO. 1960 |
| (N20)NGG | 19 | 17952516 | - | CCAGGCGGTGCTCTCCGGCCGGG | | 1 | 2 | 34 SEQ ID NO. 1961 |
| (N20)NGG | 19 | 17952517 | - | ACCAGGCGGTGCTCTCCGGCCGG | | 1 | 1 | 16 SEQ ID NO. 1962 |
| (N20)NGG | 19 | 17952521 | - | AGTGACACAGGCGGTGCTCTCCGG | | 1 | 2 | 20 SEQ ID NO. 1963 |
| (N20)NGG | 19 | 17952531 | - | TCCTGGTAACAGTGACACCAGCGG | | 1 | 3 | 35 SEQ ID NO. 1964 |
| (N20)NGG | 19 | 17952534 | - | CTGTCCTGTAACAGTGACCAGG | | 1 | 1 | 37 SEQ ID NO. 1965 |
| (N20)NGG | 19 | 17952548 | - | TAAAATCTGTTGTCTGTCCTGG | | 1 | 3 | 37 SEQ ID NO. 1966 |
| (N20)NGG | 19 | 17952561 | - | ATCCTGCACCCACTAAAATCTGG | | 1 | 3 | 30 SEQ ID NO. 1967 |
| (N20)NGG | 19 | 17953131 | + | CTCCAACCCCTGCAGCTACAAGG | | 1 | 5 | 78 SEQ ID NO. 1968 |
| (N20)NGG | 19 | 17953167 | + | AAGCCTGCGCGACCTGATCCAGG | | 1 | 1 | 7 SEQ ID NO. 1969 |
| (N20)NGG | 19 | 17953168 | + | AGCCTGCGCGACCTGATCCAGG | | 1 | 3 | 22 SEQ ID NO. 1970 |
| (N20)NGG | 19 | 17953187 | + | AGGGCCTGGAGCTTCGTGACGCGG | | 1 | 1 | 11 SEQ ID NO. 1971 |
| (N20)NGG | 19 | 17953190 | + | GCCTGAGCTTCGTGACGCGGAGG | | 1 | 1 | 3 SEQ ID NO. 1972 |
| (N20)NGG | 19 | 17953199 | + | TCGTGACGCGGAGGCGTATTCGG | | 1 | 1 | 1 SEQ ID NO. 1973 |
| (N20)NGG | 19 | 17953202 | + | TGACGGGAGGCGTATTCGAGG | | 1 | 1 | 3 SEQ ID NO. 1974 |
| (N20)NGG | 19 | 17953206 | + | GCGGAGGCGTATTCGGAGGACGG | | 1 | 1 | 7 SEQ ID NO. 1975 |
| (N20)NGG | 19 | 17953230 | + | GCGCAGAGCCCTGCCGCCGTGG | | 1 | 2 | 32 SEQ ID NO. 1976 |
| (N20)NGG | 19 | 17953242 | + | GCGCCGCGTGCCGCCTGCCAGG | | 1 | 3 | 27 SEQ ID NO. 1977 |
| (N20)NGG | 19 | 17953250 | + | TGGCCGCCTGCCAGGCAGACCGG | | 3 | 3 | 29 SEQ ID NO. 1978 |

FIG. 8 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17953263 | + | GGCAGACCGGCACTCGCTCATGG | 1 | 1 | 9 | SEQ ID NO. 1979 |
| (N20)NGG | 19 | 17953278 | + | GCTCATGGCCAAGTACATCATGG |   | 2 | 4 | 39 SEQ ID NO. 1980 |
| (N20)NGG | 19 | 17953284 | + | GGCCAAGTACATCATGGACCTGG |   | 1 | 1 | 13 SEQ ID NO. 1981 |
| (N20)NGG | 19 | 17953289 | + | AGTACATCATGGACCTGGAGCGG |   | 1 | 1 | 34 SEQ ID NO. 1982 |
| (N20)NGG | 19 | 17953293 | + | CATCATGGACCTGGAGCGGCTGG |   | 1 | 5 | 22 SEQ ID NO. 1983 |
| (N20)NGG | 19 | 17953303 | + | CTGGAGCGGCTGGATCCAGCCGG |   | 1 | 3 | 46 SEQ ID NO. 1984 |
| (N20)NGG | 19 | 17953304 | + | TGGAGCGGCTGGATCCAGCCGGG |   | 2 | 4 | 44 SEQ ID NO. 1985 |
| (N20)NGG | 19 | 17953305 | + | GGAGCGGCTGGATCCAGCCGGGG |   | 1 | 6 | 33 SEQ ID NO. 1986 |
| (N20)NGG | 19 | 17953326 | + | GGCCCGCCGAGACCTTCCACGTGG |   | 1 | 1 | 8 SEQ ID NO. 1987 |
| (N20)NGG | 19 | 17953327 | + | GCCCGCCGAGACCTTCCACGTGGG |   | 1 | 1 | 5 SEQ ID NO. 1988 |
| (N20)NGG | 19 | 17953336 | + | ACCTTCCACGTGGGCCTCCCTGG |   | 2 | 11 | 234 SEQ ID NO. 1989 |
| (N20)NGG | 19 | 17953337 | + | CCTTCCACGTGGGCCTCCCCTGGG |   | 2 | 30 | 1326 SEQ ID NO. 1990 |
| (N20)NGG | 19 | 17953338 | + | CTTCCACGTGGGCCTCCCTGGGG |   | 1 | 2 | 74 SEQ ID NO. 1991 |
| (N20)NGG | 19 | 17953345 | + | GTGGGCCTCCCTGGGGCCCTTGG |   | 1 | 6 | 132 SEQ ID NO. 1992 |
| (N20)NGG | 19 | 17953348 | + | GGCCTCCCTGGGGCCCTTGGTGG |   | 1 | 7 | 129 SEQ ID NO. 1993 |
| (N20)NGG | 19 | 17953357 | + | GGGGCCCTTGGTGGCCACGACGG |   | 1 | 2 | 33 SEQ ID NO. 1994 |
| (N20)NGG | 19 | 17953358 | + | CCTTGTGGTGGCCACGACGGGCTGG |   | 1 | 5 | 23 SEQ ID NO. 1995 |
| (N20)NGG | 19 | 17953362 | + | CTTGGTGGCCACGACGGGCTGG |   | 1 | 3 | 26 SEQ ID NO. 1996 |
| (N20)NGG | 19 | 17953363 | + | TTGGTGGCCACGACGGGCTGGGG |   | 1 | 1 | 11 SEQ ID NO. 1997 |
| (N20)NGG | 19 | 17953364 | + | TGGTGGCCACGACGGGCTGGGGG |   | 1 | 3 | 26 SEQ ID NO. 1998 |
| (N20)NGG | 19 | 17953377 | + | CGGGCTGGGGCTGCTCCGCGTGG |   | 1 | 5 | 51 SEQ ID NO. 1999 |
| (N20)NGG | 19 | 17953381 | + | CTGGGGCTGCTCCGCGTGGCTGG |   | 1 | 3 | 49 SEQ ID NO. 2000 |
| (N20)NGG | 19 | 17953387 | + | CTGCTCCGCGTGGCTGGTGACGG |   | 1 | 1 | 35 SEQ ID NO. 2001 |
| (N20)NGG | 19 | 17953390 | + | CTCCGCGTGGCTGGTGACGGCGG |   | 1 | 1 | 15 SEQ ID NO. 2002 |
| (N20)NGG | 19 | 17953400 | + | CTGGTGACGGCGGCATCGCCTGG |   | 2 | 2 | 5 SEQ ID NO. 2003 |
| (N20)NGG | 19 | 17953407 | + | CGGCGGCATCGCCTGACCCAGG |   | 1 | 1 | 13 SEQ ID NO. 2004 |
| (N20)NGG | 19 | 17953408 | + | GGCGGCATCGCCTGACCCAGGG |   | 1 | 1 | 17 SEQ ID NO. 2005 |
| (N20)NGG | 19 | 17953416 | + | CGCCTGACCCAGGGAGAACAGG |   | 1 | 3 | 29 SEQ ID NO. 2006 |
| (N20)NGG | 19 | 17953419 | + | CTGACCCAGGGAGAACAGGAGAG |   | 2 | 13 | 137 SEQ ID NO. 2007 |
| (N20)NGG | 19 | 17953424 | + | CCAGGGAGAACAGGAGAGGTGAGG |   | 1 | 7 | 157 SEQ ID NO. 2008 |
| (N20)NGG | 19 | 17953425 | + | CCAGGGAGAACAGGAGAGGTGAGGG |   | 2 | 9 | 149 SEQ ID NO. 2009 |
| (N20)NGG | 19 | 17953428 | + | GGGAGAACAGGAGAGGTGAGGGCGG |   | 3 | 33 | 396 SEQ ID NO. 2010 |
| (N20)NGG | 19 | 17953441 | + | GTGAGGGCGGACTCCCCGCTGG |   | 1 | 2 | 12 SEQ ID NO. 2011 |

FIG. 8 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 19 | 17953442 | + | TGAGGGCGGACTCCCCGCTGGG | 1 | 1 | 9 | SEQ ID NO. | 2012 |
| (N20)NGG | 19 | 17953102 | - | GCTGCAGGGGTTGGAGGGGAGG | 2 | 23 | 266 | SEQ ID NO. | 2013 |
| (N20)NGG | 19 | 17953103 | - | AGCTGCAGGGGTTGGAGGGGAG | 1 | 19 | 260 | SEQ ID NO. | 2014 |
| (N20)NGG | 19 | 17953106 | - | TGTAGCTGCAGGGGTTGGAGGG | 1 | 7 | 99 | SEQ ID NO. | 2015 |
| (N20)NGG | 19 | 17953107 | - | TTGTAGCTGCAGGGGTTGGAGG | 1 | 2 | 61 | SEQ ID NO. | 2016 |
| (N20)NGG | 19 | 17953108 | - | CTTGTAGCTGCAGGGGTTGGAG | 1 | 6 | 56 | SEQ ID NO. | 2017 |
| (N20)NGG | 19 | 17953111 | - | GGCCTTGTAGCTGCAGGGGTTGG | 1 | 4 | 54 | SEQ ID NO. | 2018 |
| (N20)NGG | 19 | 17953115 | - | GGCAGGCCTTGTAGCTGCAGGGG | 1 | 5 | 51 | SEQ ID NO. | 2019 |
| (N20)NGG | 19 | 17953116 | - | AGGCAGGCCTTGTAGCTGCAGGG | 1 | 3 | 43 | SEQ ID NO. | 2020 |
| (N20)NGG | 19 | 17953117 | - | TAGGCAGGCCTTGTAGCTGCAGG | 1 | 2 | 32 | SEQ ID NO. | 2021 |
| (N20)NGG | 19 | 17953132 | - | GCGCAGGCTTGGGGTAGGCAGG | 1 | 4 | 37 | SEQ ID NO. | 2022 |
| (N20)NGG | 19 | 17953136 | - | GGTCGCGCAGGCTTGGGGTAGG | 1 | 2 | 28 | SEQ ID NO. | 2023 |
| (N20)NGG | 19 | 17953140 | - | ATCAGTCGCGCAGGCTTGGGG | 1 | 1 | 5 | SEQ ID NO. | 2024 |
| (N20)NGG | 19 | 17953141 | - | GATCAGTCGCGCAGGCTTGGG | 1 | 1 | 10 | SEQ ID NO. | 2025 |
| (N20)NGG | 19 | 17953142 | - | GGATCAGTCGCGCAGGCTTGG | 1 | 1 | 11 | SEQ ID NO. | 2026 |
| (N20)NGG | 19 | 17953143 | - | TGGATCAGTCGCGCAGGCTTGG | 1 | 1 | 4 | SEQ ID NO. | 2027 |
| (N20)NGG | 19 | 17953148 | - | GGCCCTTGGATCAGTCGCGCAGG | 1 | 3 | 8 | SEQ ID NO. | 2028 |
| (N20)NGG | 19 | 17953157 | - | CGAAGCTCAGGCCCTTGGATCAGG | 1 | 3 | 34 | SEQ ID NO. | 2029 |
| (N20)NGG | 19 | 17953163 | - | GCGTCACGAAGCTCAGGCCCTGG | 1 | 1 | 13 | SEQ ID NO. | 2030 |
| (N20)NGG | 19 | 17953169 | - | GCCTCCGTCACGAAGCTCAGG | 1 | 1 | 25 | SEQ ID NO. | 2031 |
| (N20)NGG | 19 | 17953216 | - | GCAGGCGGCCACGCCGCGCAGG | 1 | 3 | 21 | SEQ ID NO. | 2032 |
| (N20)NGG | 19 | 17953217 | - | GCAGGCGGCCACGCCGCGCAGG | 1 | 3 | 35 | SEQ ID NO. | 2033 |
| (N20)NGG | 19 | 17953223 | - | CTGCCTGGCAGGCGGCCACGCGG | 2 | 8 | 56 | SEQ ID NO. | 2034 |
| (N20)NGG | 19 | 17953231 | - | GTGCCGGTCGTGCCTGGCAGGCGG | 1 | 2 | 37 | SEQ ID NO. | 2035 |
| (N20)NGG | 19 | 17953234 | - | CGAGTGCCGGTCTGCCTGGCAGG | 1 | 2 | 14 | SEQ ID NO. | 2036 |
| (N20)NGG | 19 | 17953238 | - | TGAGCGAGTGCCGGTCTGCCTGG | 1 | 1 | 9 | SEQ ID NO. | 2037 |
| (N20)NGG | 19 | 17953247 | - | ACTTGGCCATGAGCGAGTGCCGG | 1 | 2 | 8 | SEQ ID NO. | 2038 |
| (N20)NGG | 19 | 17953264 | - | CTCCAGTCCATGATGTACTTGG | 1 | 4 | 29 | SEQ ID NO. | 2039 |
| (N20)NGG | 19 | 17953280 | - | CGGCTGATCCAGCCGCTCCAGG | 2 | 5 | 33 | SEQ ID NO. | 2040 |
| (N20)NGG | 19 | 17953296 | - | AAGGTCTCGGCGGCCCCGGCTGG | 1 | 2 | 12 | SEQ ID NO. | 2041 |
| (N20)NGG | 19 | 17953300 | - | GTGGAAGTCTCGGCGGCCCCGG | 1 | 2 | 11 | SEQ ID NO. | 2042 |
| (N20)NGG | 19 | 17953306 | - | GCCCACGTGGAAGGTCTCGGCGG | 1 | 2 | 12 | SEQ ID NO. | 2043 |
| (N20)NGG | 19 | 17953309 | - | GAGGCCCACGTGGAAGGTCTCGG | 1 | 2 | 30 | SEQ ID NO. | 2044 |

FIG. 8 cont.

| site type | site_chr omosome | site_start_ nucleotide | site_s trand | target_site_sequence_with_NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 19 | 17953315 | - | CCCAGGGAGGCCCACGTGAAGG | | 1 | 4 | 102 SEQ ID NO. 2045 |
| (N20)NGG | 19 | 17953319 | - | GGGCCCAGGGAGGCCCACGTGG | | 2 | 8 | 88 SEQ ID NO. 2046 |
| (N20)NGG | 19 | 17953328 | - | GGCCACCAAGGGCCCAGGGAGG | | 1 | 8 | 112 SEQ ID NO. 2047 |
| (N20)NGG | 19 | 17953331 | - | CGTGGCCACCAAGGGCCCAGGG | | 1 | 6 | 45 SEQ ID NO. 2048 |
| (N20)NGG | 19 | 17953332 | - | TCGTGGCCACCAAGGGCCCAGG | | 1 | 3 | 42 SEQ ID NO. 2049 |
| (N20)NGG | 19 | 17953339 | - | CAGCCCGTCGTGGCCACCAAGG | | 1 | 1 | 46 SEQ ID NO. 2050 |
| (N20)NGG | 19 | 17953340 | - | CCAGCCCGTCGTGGCCACCAAG | | 1 | 4 | 59 SEQ ID NO. 2051 |
| (N20)NGG | 19 | 17953349 | - | GGAGCAGCCCCAGCCCGTCGTG | | 1 | 6 | 49 SEQ ID NO. 2052 |
| (N20)NGG | 19 | 17953370 | - | TGCCCCGTCACCAGCCACGCGG | | 1 | 1 | 14 SEQ ID NO. 2053 |
| (N20)NGG | 19 | 17953396 | - | CTCCTGTTCTCCCTGGGTCCAGG | | 2 | 9 | 115 SEQ ID NO. 2054 |
| (N20)NGG | 19 | 17953402 | - | CCTCACCTCCTGTTCTCCCTGGG | | 1 | 7 | 141 SEQ ID NO. 2055 |
| (N20)NGG | 19 | 17953403 | - | CCCTCACCTCCTGTTCTCCCTGG | | 1 | 9 | 145 SEQ ID NO. 2056 |
| (N20)NGG | 19 | 17953850 | + | CCCCAGCACCGCAGTGACCTGG | | 1 | 5 | 53 SEQ ID NO. 2057 |
| (N20)NGG | 19 | 17953857 | + | CACCGCAGTGACCTGCTGAGTGG | | 1 | 2 | 32 SEQ ID NO. 2058 |
| (N20)NGG | 19 | 17953858 | + | ACCGCAGTGACCTGGTGAGTGGG | | 1 | 2 | 15 SEQ ID NO. 2059 |
| (N20)NGG | 19 | 17953871 | + | GGTGAGTGGGGCCTCCCCGTGG | | 1 | 4 | 34 SEQ ID NO. 2060 |
| (N20)NGG | 19 | 17953872 | + | GTGAGTGGGGCCTCCCCGTGGG | | 1 | 1 | 10 SEQ ID NO. 2061 |
| (N20)NGG | 19 | 17953886 | + | CCCCGTGGGCCTCAGTCTCAAGG | | 1 | 6 | 39 SEQ ID NO. 2062 |
| (N20)NGG | 19 | 17953892 | + | GGGCCTCAGTCTCAAGGAGCAGG | | 1 | 2 | 44 SEQ ID NO. 2063 |
| (N20)NGG | 19 | 17953893 | + | GGCCTCAGTCTCAAGGAGCAGGG | | 1 | 2 | 36 SEQ ID NO. 2064 |
| (N20)NGG | 19 | 17953910 | + | GCAGGGTGAGTGTCTCAGCCTGG | | 1 | 6 | 70 SEQ ID NO. 2065 |
| (N20)NGG | 19 | 17953919 | + | GTGTCTCAGCCTGGCCGTGTTGG | | 1 | 4 | 32 SEQ ID NO. 2066 |
| (N20)NGG | 19 | 17953925 | + | CAGCCTGGCCGTGTTGGACCTGG | | 1 | 10 | 30 SEQ ID NO. 2067 |
| (N20)NGG | 19 | 17953930 | + | TGGCCGTGTTGGACCTGGCCCGG | | 1 | 1 | 15 SEQ ID NO. 2068 |
| (N20)NGG | 19 | 17953934 | + | CGTGTTGGACCTGGCCCGGATGG | | 1 | 2 | 8 SEQ ID NO. 2069 |
| (N20)NGG | 19 | 17953946 | + | GGCCCGGATGGCCGGAGAGCAGG | | 1 | 1 | 10 SEQ ID NO. 2070 |
| (N20)NGG | 19 | 17953954 | + | TGGCGCCAGAGCAGGCCCAGCCGG | | 1 | 4 | 34 SEQ ID NO. 2071 |
| (N20)NGG | 19 | 17953958 | + | GCGAGAGCAGGCCCAGCGCCGG | | 1 | 3 | 47 SEQ ID NO. 2072 |
| (N20)NGG | 19 | 17953959 | + | CGAGAGCAGGCCCAGCGGCCGGG | | 1 | 9 | 45 SEQ ID NO. 2073 |
| (N20)NGG | 19 | 17953981 | + | GAGAGCTGCTGAAGACTGTCAGG | | 1 | 3 | 36 SEQ ID NO. 2074 |
| (N20)NGG | 19 | 17953995 | + | ACTGTCAGGTGAGAGCCACCAGG | | 2 | 5 | 65 SEQ ID NO. 2075 |
| (N20)NGG | 19 | 17954001 | + | AGGTGAGAGCCACCAGGCTGTGG | | 3 | 27 | 432 SEQ ID NO. 2076 |
| (N20)NGG | 19 | 17954002 | + | GGTGAGAGCCACCAGGCTGTGGG | | 1 | 5 | 69 SEQ ID NO. 2077 |

FIG. 8 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17954003 | + | GTGAGAGCCACCAGGCTGTGGGG | 1 | 8 | 71 | SEQ ID NO. 2078 |
| (N20)NGG | 19 | 17953816 | - | GGTGCTGGGGGCCGCCACAGGG | | 2 | 29 | SEQ ID NO. 2079 |
| (N20)NGG | 19 | 17953817 | - | CGGTGCTGGGGGCCGCCACAGG | | 1 | 23 | SEQ ID NO. 2080 |
| (N20)NGG | 19 | 17953827 | - | CAGGTCACTGCGGTGCTGGGGG | 1 | 4 | 41 | SEQ ID NO. 2081 |
| (N20)NGG | 19 | 17953828 | - | CCAGGTCACTGCGGTGCTGGGG | 1 | 4 | 52 | SEQ ID NO. 2082 |
| (N20)NGG | 19 | 17953829 | - | ACCAGGTCACTGCGGTGCTGGG | 1 | 4 | 24 | SEQ ID NO. 2083 |
| (N20)NGG | 19 | 17953830 | - | CACCAGGTCACTGCGGTGCTGG | 1 | 1 | 29 | SEQ ID NO. 2084 |
| (N20)NGG | 19 | 17953831 | - | TCACCAGGTCACTGCGGTGCTG | 1 | 1 | 17 | SEQ ID NO. 2085 |
| (N20)NGG | 19 | 17953837 | - | GCCCACTCACCAGGTCACTGCG | 1 | 5 | 45 | SEQ ID NO. 2086 |
| (N20)NGG | 19 | 17953846 | - | CGGGGAGGCGCCCACTCACCAG | 1 | 3 | 35 | SEQ ID NO. 2087 |
| (N20)NGG | 19 | 17953861 | - | TGAGACTGAGGCCCACGGGGAG | 1 | 5 | 104 | SEQ ID NO. 2088 |
| (N20)NGG | 19 | 17953864 | - | CCTTGAGACTGAGGCCCACGGG | 1 | 4 | 29 | SEQ ID NO. 2089 |
| (N20)NGG | 19 | 17953865 | - | TCCTTGAGACTGAGGCCCACGG | 2 | 2 | 41 | SEQ ID NO. 2090 |
| (N20)NGG | 19 | 17953866 | - | CTCCTTGAGACTGAGGCCCACG | 2 | 8 | 69 | SEQ ID NO. 2091 |
| (N20)NGG | 19 | 17953873 | - | CACCCTGCTCCTTGAGACTGAGG | 1 | 2 | 40 | SEQ ID NO. 2092 |
| (N20)NGG | 19 | 17953906 | - | GGGCCAGGTCCAACACGGCCAGG | 1 | 2 | 24 | SEQ ID NO. 2093 |
| (N20)NGG | 19 | 17953911 | - | CATCCGGGCCAGGTCCAACACGG | 1 | 2 | 19 | SEQ ID NO. 2094 |
| (N20)NGG | 19 | 17953921 | - | GCTCTCGCGCCATCCGGGCCAGG | 1 | 1 | 6 | SEQ ID NO. 2095 |
| (N20)NGG | 19 | 17953926 | - | GGCCTGCTCTCGCGCCATCCGG | 1 | 2 | 16 | SEQ ID NO. 2096 |
| (N20)NGG | 19 | 17953927 | - | GGGCCTGCTCTCGCGCCATCCG | 1 | 2 | 12 | SEQ ID NO. 2097 |
| (N20)NGG | 19 | 17953947 | - | CAGCAGCTCTCCGGCCGCTGGG | 1 | 1 | 38 | SEQ ID NO. 2098 |
| (N20)NGG | 19 | 17953948 | - | TCAGCAGCTCTCCGGCCGCTGG | 1 | 1 | 25 | SEQ ID NO. 2099 |
| (N20)NGG | 19 | 17953955 | - | ACAGTCTTCAGCAGCTCTCCGG | 1 | 4 | 45 | SEQ ID NO. 2100 |
| (N20)NGG | 19 | 17954206 | + | ACAGCTTTTACTTCCCCAATTGG | 1 | 5 | 52 | SEQ ID NO. 2101 |
| (N20)NGG | 19 | 17954211 | + | TTTTACTTCCCCAATTGGTTTGG | 1 | 3 | 55 | SEQ ID NO. 2102 |
| (N20)NGG | 19 | 17954212 | + | TTTACTTCCCCAATTGGTTTGGG | 1 | 2 | 32 | SEQ ID NO. 2103 |
| (N20)NGG | 19 | 17954216 | + | CTTCCCCAATTGGTTTGGCTGG | 1 | 1 | 14 | SEQ ID NO. 2104 |
| (N20)NGG | 19 | 17954235 | + | CTTGAGAAGTGCCACCGCTTCGG | 1 | 2 | 13 | SEQ ID NO. 2105 |
| (N20)NGG | 19 | 17954236 | + | TGGAGAAGTGCCACCGCTTCGG | 1 | 2 | 14 | SEQ ID NO. 2106 |
| (N20)NGG | 19 | 17954246 | + | CCACCGCTTCGGGCTACGCAAGG | 1 | 1 | 2 | SEQ ID NO. 2107 |
| (N20)NGG | 19 | 17954252 | + | CTTCGGGCTACGCAAGGATTTGG | 1 | 2 | 4 | SEQ ID NO. 2108 |
| (N20)NGG | 19 | 17954282 | + | TATCCTTGACCTGCCAGTCCTGG | 1 | 2 | 28 | SEQ ID NO. 2109 |
| (N20)NGG | 19 | 17954300 | + | CCTGGAGCACCTCTTTGCCCAGG | 1 | 7 | 57 | SEQ ID NO. 2110 |

FIG. 8 cont.

| site type | site chr omosome | site start nucleotide | site strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17954303 | + | GGAGCACCTCTTTGCCCAGGTGG |   |   | 4 | 46 SEQ ID NO. 2111 |
| (N20)NGG | 19 | 17954304 | + | GAGCACCTCTTTGCCCAGGTGGG | 1 |   | 6 | 43 SEQ ID NO. 2112 |
| (N20)NGG | 19 | 17954305 | + | AGCACCTCTTTGCCCAGGTGGGG | 1 |   | 7 | 64 SEQ ID NO. 2113 |
| (N20)NGG | 19 | 17954315 | + | TGCCCAGGTGGGGTTCTGCCTGG | 3 |   | 4 | 64 SEQ ID NO. 2114 |
| (N20)NGG | 19 | 17954316 | + | GCCCAGGTGGGGTTCTGCCTGGG | 2 |   | 4 | 58 SEQ ID NO. 2115 |
| (N20)NGG | 19 | 17954317 | + | CCCAGGTGGGGTTCTGCCTGGGG | 2 |   | 7 | 75 SEQ ID NO. 2116 |
| (N20)NGG | 19 | 17954163 | - | GTGAGGAGAGGAGAGAACCCTGG | 1 |   | 6 | 147 SEQ ID NO. 2117 |
| (N20)NGG | 19 | 17954175 | - | GAAGTAAAAGCTGTGAGGAGAGG | 1 |   | 7 | 74 SEQ ID NO. 2118 |
| (N20)NGG | 19 | 17954180 | - | TTGGGGAAGTAAAAGCTGTGAGG | 1 |   | 6 | 70 SEQ ID NO. 2119 |
| (N20)NGG | 19 | 17954197 | - | TCTCCAGCCCAAACCAATTGGGG | 1 |   | 1 | 40 SEQ ID NO. 2120 |
| (N20)NGG | 19 | 17954198 | - | TTCTCCAGCCCAAACCAATTGGG | 1 |   | 3 | 53 SEQ ID NO. 2121 |
| (N20)NGG | 19 | 17954199 | - | CTTCTCCAGCCCAAACCAATTGG | 1 |   | 3 | 46 SEQ ID NO. 2122 |
| (N20)NGG | 19 | 17954224 | - | CCTTGCGTAGCCCGAAGCGGTGG | 1 |   | 1 | 5 SEQ ID NO. 2123 |
| (N20)NGG | 19 | 17954227 | - | AATCCTTGCGTAGCCCGAAGCGG | 1 |   | 1 | 3 SEQ ID NO. 2124 |
| (N20)NGG | 19 | 17954253 | - | TGGCAGGTCAAGGATAGCACTGG | 1 |   | 1 | 40 SEQ ID NO. 2125 |
| (N20)NGG | 19 | 17954263 | - | GCTCCAGGACTGGCAGGTCAAGG | 1 |   | 3 | 62 SEQ ID NO. 2126 |
| (N20)NGG | 19 | 17954269 | - | AGAGGTGCTCCAGGACTGGCAGG | 1 |   | 4 | 60 SEQ ID NO. 2127 |
| (N20)NGG | 19 | 17954273 | - | GCAAAGAGGTGCTCCAGGACTGG | 1 |   | 2 | 34 SEQ ID NO. 2128 |
| (N20)NGG | 19 | 17954278 | - | CCTGGGCAAAGAGGTGCTCCAGG | 1 |   | 3 | 54 SEQ ID NO. 2129 |
| (N20)NGG | 19 | 17954287 | - | AGAACCCACCTGGGCAAAGAGAG | 2 |   | 2 | 46 SEQ ID NO. 2130 |
| (N20)NGG | 19 | 17954295 | - | CCCCAGGCAGAACCCCACCTGGG | 2 |   | 6 | 89 SEQ ID NO. 2131 |
| (N20)NGG | 19 | 17954296 | - | ACCCCAGGCAGAACCCCACCTGG | 1 |   | 4 | 61 SEQ ID NO. 2132 |
| (N20)NGG | 19 | 17954585 | + | CTGATGGGACCATCCCCTGTAGG | 1 |   | 2 | 22 SEQ ID NO. 2133 |
| (N20)NGG | 19 | 17954620 | + | GTACCACTCCCTCTTTGCTCTGG | 1 |   | 2 | 24 SEQ ID NO. 2134 |
| (N20)NGG | 19 | 17954626 | + | CTCCCTCTTTTGCTCTGGCCACGG | 1 |   | 2 | 126 SEQ ID NO. 2135 |
| (N20)NGG | 19 | 17954629 | + | CCTCTTTTGCTCTGGCCACGGAGG | 1 |   | 1 | 45 SEQ ID NO. 2136 |
| (N20)NGG | 19 | 17954643 | + | CCACGGAGGACCTGTCCTGCTGG | 1 |   | 1 | 24 SEQ ID NO. 2137 |
| (N20)NGG | 19 | 17954671 | + | CCCGAGCCACATCTTCTCCGTGG | 1 |   | 3 | 17 SEQ ID NO. 2138 |
| (N20)NGG | 19 | 17954674 | + | GAGCCACATCTTCTCCGTGGAGG | 1 |   | 2 | 23 SEQ ID NO. 2139 |
| (N20)NGG | 19 | 17954703 | + | GCACCCAAGTCCTGCTGTACAGG | 1 |   | 4 | 22 SEQ ID NO. 2140 |
| (N20)NGG | 19 | 17954709 | + | AAGTCCTGCTGTACAGGATTCGG | 1 |   | 1 | 32 SEQ ID NO. 2141 |
| (N20)NGG | 19 | 17954713 | + | CCTGCTGTACAGGATTCGGTAGG | 1 |   | 1 | 8 SEQ ID NO. 2142 |
| (N20)NGG | 19 | 17954572 | - | GGCAGGATGCCTACAGGGGATGG | 1 |   | 3 | 71 SEQ ID NO. 2143 |

FIG. 8 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 19 | 17954576 | - | CACAGGCAGGATGCCTACAGGGG | 1 | 8 | 69 | SEQ ID NO. 2144 |
| (N20)NGG | 19 | 17954577 | - | ACACAGGCAGGATGCCTACAGGG | 1 | 5 | 54 | SEQ ID NO. 2145 |
| (N20)NGG | 19 | 17954578 | - | TACACAGGCAGGATGCCTACAGG | 1 | 2 | 20 | SEQ ID NO. 2146 |
| (N20)NGG | 19 | 17954589 | - | AGAGGGAGTGGTACACAGGCAGG | 1 | 5 | 64 | SEQ ID NO. 2147 |
| (N20)NGG | 19 | 17954593 | - | GCAAAGAGGGAGTGGTACACAGG | 1 | 3 | 32 | SEQ ID NO. 2148 |
| (N20)NGG | 19 | 17954601 | - | TGGCCAGAGCAAAGAGGGAGTGG | 2 | 15 | 482 | SEQ ID NO. 2149 |
| (N20)NGG | 19 | 17954606 | - | CTCCGTGGCCAGAGCAAAGAGGG | 1 | 2 | 39 | SEQ ID NO. 2150 |
| (N20)NGG | 19 | 17954607 | - | CCTCCGTGGCCAGAGCAAAGAGG | 1 | 7 | 41 | SEQ ID NO. 2151 |
| (N20)NGG | 19 | 17954621 | - | CCAGCAGGACAGGTCTCCGTGG | 1 | 1 | 32 | SEQ ID NO. 2152 |
| (N20)NGG | 19 | 17954631 | - | TCGGGGGAACCAGCAGGACAGG | 1 | 1 | 20 | SEQ ID NO. 2153 |
| (N20)NGG | 19 | 17954636 | - | GTGGCTCGGGGGAACCAGCAGG | 1 | 2 | 25 | SEQ ID NO. 2154 |
| (N20)NGG | 19 | 17954646 | - | CGGAGAAGATGTGCTCGGGGGG | 1 | 1 | 21 | SEQ ID NO. 2155 |
| (N20)NGG | 19 | 17954647 | - | ACGGAGAAGATGTGCTCGGGGG | 1 | 2 | 17 | SEQ ID NO. 2156 |
| (N20)NGG | 19 | 17954648 | - | CACGGAGAAGATGTGGCTCGGG | 1 | 2 | 12 | SEQ ID NO. 2157 |
| (N20)NGG | 19 | 17954649 | - | CCACGGAGAAGATGTGGCTCGG | 1 | 4 | 25 | SEQ ID NO. 2158 |
| (N20)NGG | 19 | 17954650 | - | TCCACGGAGAAGATGTGGCTCG | 1 | 3 | 31 | SEQ ID NO. 2159 |
| (N20)NGG | 19 | 17954655 | - | CATCCTCCACGGAGAAGATGTGG | 1 | 3 | 32 | SEQ ID NO. 2160 |
| (N20)NGG | 19 | 17954666 | - | TTGGGTGCTGGCATCCTCCACGG | 1 | 3 | 53 | SEQ ID NO. 2161 |
| (N20)NGG | 19 | 17954678 | - | GTACAGCAGGACTTGGGTGCTGG | 1 | 3 | 38 | SEQ ID NO. 2162 |
| (N20)NGG | 19 | 17954684 | - | AATCCTGTACAGCAGGACTTGGG | 1 | 2 | 38 | SEQ ID NO. 2163 |
| (N20)NGG | 19 | 17954685 | - | GAATCCTGTACAGCAGGACTTGG | 1 | 2 | 25 | SEQ ID NO. 2164 |
| (N20)NGG | 19 | 17954691 | - | CCTACCGAATCCTGTACAGCAGG | 1 | 1 | 2 | SEQ ID NO. 2165 |
| (N20)NGG | 19 | 17955045 | + | CCCCAGGCAAGTTGCACTCATGG | 1 | 4 | 47 | SEQ ID NO. 2166 |
| (N20)NGG | 19 | 17955105 | + | TTCATGCAGCCTCTTTGTCCACGG | 1 | 2 | 48 | SEQ ID NO. 2167 |
| (N20)NGG | 19 | 17955108 | + | ATGCAGCCTCTTTGTCCACGGAGG | 1 | 2 | 13 | SEQ ID NO. 2168 |
| (N20)NGG | 19 | 17955112 | + | AGCCTCTTGTCCACGGAGGCTGG | 1 | 1 | 19 | SEQ ID NO. 2169 |
| (N20)NGG | 19 | 17955140 | + | TGCATGTGCTGCTGCCCGCTCGG | 1 | 2 | 22 | SEQ ID NO. 2170 |
| (N20)NGG | 19 | 17955141 | + | GCATGTGCTGCTGCCCGCTCGGG | 1 | 3 | 27 | SEQ ID NO. 2171 |
| (N20)NGG | 19 | 17955142 | + | CATGTGCTGCTGCCCGCTCGGGG | 1 | 2 | 7 | SEQ ID NO. 2172 |
| (N20)NGG | 19 | 17955148 | + | CTGCTGCCCGCTCGGGGCCCGG | 1 | 4 | 52 | SEQ ID NO. 2173 |
| (N20)NGG | 19 | 17955149 | + | TGCTGCCCGCTCGGGGCCCGGG | 1 | 1 | 51 | SEQ ID NO. 2174 |
| (N20)NGG | 19 | 17955178 | + | CAGGCCTATCTTTCTCCTTTGG | 1 | 2 | 27 | SEQ ID NO. 2175 |
| (N20)NGG | 19 | 17955179 | + | AGCGCCTATCTTTCTCCTTTGGG | 1 | 2 | 23 | SEQ ID NO. 2176 |

FIG. 8 cont.

| site type | site chromosome | site start nucleotide | site strand | target site sequence with NGG | genome wide hits with 1 or less mismatches | genome wide hits with 2 or less mismatches | genome wide hits with 3 or less mismatches | |
|---|---|---|---|---|---|---|---|---|
| (N20)NGG | 19 | 17955180 | + | GCGCCTATCTTTCTCCTTTGGGG | 1 | 1 | 20 | SEQ ID NO. 2177 |
| (N20)NGG | 19 | 17955189 | + | TTTCTCCTTTGGGACCACTTGG | 1 | 3 | 51 | SEQ ID NO. 2178 |
| (N20)NGG | 19 | 17955195 | + | CTTTGGGACCACTTGGCTGAGG | 1 | 4 | 72 | SEQ ID NO. 2179 |
| (N20)NGG | 19 | 17955210 | + | GGCTGAGGACCTGTGCGTGCAGG | 1 | 4 | 33 | SEQ ID NO. 2180 |
| (N20)NGG | 19 | 17955219 | + | CCTGTGCGTGCAGGCTGCCAAGG | 1 | 4 | 40 | SEQ ID NO. 2181 |
| (N20)NGG | 19 | 17955226 | + | GTGCAGGCTGCCAAGGCCAGCGG | 1 | 10 | 130 | SEQ ID NO. 2182 |
| (N20)NGG | 19 | 17955244 | + | AGCGGTGAGTGCATCCCTAGTGG | 2 | 2 | 6 | SEQ ID NO. 2183 |
| (N20)NGG | 19 | 17955249 | + | TGAGTGCATCCCTAGTGGATCGG | 1 | 2 | 31 | SEQ ID NO. 2184 |
| (N20)NGG | 19 | 17955250 | + | GAGTGCATCCCTAGTGGATCGGG | 1 | 1 | 10 | SEQ ID NO. 2185 |
| (N20)NGG | 19 | 17955023 | - | CCATGAGTGCAACTTGCCTGGGG | 1 | 12 | 546 | SEQ ID NO. 2186 |
| (N20)NGG | 19 | 17955024 | - | GCCATGAGTGCAACTTGCCTGGG | 1 | 9 | 338 | SEQ ID NO. 2187 |
| (N20)NGG | 19 | 17955025 | - | TGCCATGAGTGCAACTTGCCTGG | 1 | 3 | 34 | SEQ ID NO. 2188 |
| (N20)NGG | 19 | 17955048 | - | AGGGGCTCTCTTCACTTGGAGG | 1 | 1 | 17 | SEQ ID NO. 2189 |
| (N20)NGG | 19 | 17955051 | - | ATCAGGGCGTCTCTTCACTTGG | 1 | 1 | 12 | SEQ ID NO. 2190 |
| (N20)NGG | 19 | 17955066 | - | CATGAACCTGAGGGATCAGGGG | 1 | 2 | 19 | SEQ ID NO. 2191 |
| (N20)NGG | 19 | 17955067 | - | GCATGAACCTGAGGGATCAGGG | 1 | 1 | 23 | SEQ ID NO. 2192 |
| (N20)NGG | 19 | 17955068 | - | TGCATGAACCTGAGGGATCAGG | 1 | 1 | 21 | SEQ ID NO. 2193 |
| (N20)NGG | 19 | 17955074 | - | AGAGGCTGCATGAACGCTCAGG | 1 | 2 | 24 | SEQ ID NO. 2194 |
| (N20)NGG | 19 | 17955075 | - | AAGAGGCTGCATGAACGCTCAG | 1 | 2 | 34 | SEQ ID NO. 2195 |
| (N20)NGG | 19 | 17955092 | - | CACCAGCTCCGTGCAAGAGG | 1 | 3 | 27 | SEQ ID NO. 2196 |
| (N20)NGG | 19 | 17955100 | - | ATGCAGGCACCAGCCTCCGTGG | 1 | 3 | 36 | SEQ ID NO. 2197 |
| (N20)NGG | 19 | 17955115 | - | AGCGGGCAGCAGCACATGCAGG | 2 | 4 | 58 | SEQ ID NO. 2198 |
| (N20)NGG | 19 | 17955116 | - | GAGCGGGCAGCAGCACATGCAG | 1 | 3 | 47 | SEQ ID NO. 2199 |
| (N20)NGG | 19 | 17955132 | - | GGGGGCCCGGGCCCCGAGCGGG | 1 | 13 | 120 | SEQ ID NO. 2200 |
| (N20)NGG | 19 | 17955133 | - | GGGGGCCCGGGCCCCGAGCGG | 1 | 8 | 125 | SEQ ID NO. 2201 |
| (N20)NGG | 19 | 17955143 | - | ATAGGCGCTGGGGGCCCGGGG | 1 | 2 | 13 | SEQ ID NO. 2202 |
| (N20)NGG | 19 | 17955144 | - | GATAGGCGCTGGGGGCCCGGG | 1 | 2 | 33 | SEQ ID NO. 2203 |
| (N20)NGG | 19 | 17955145 | - | AGATAGGCGCTGGGGGCCCGG | 1 | 1 | 26 | SEQ ID NO. 2204 |
| (N20)NGG | 19 | 17955150 | - | AGAAAGATAGGCGCTGGGGGG | 1 | 1 | 45 | SEQ ID NO. 2205 |
| (N20)NGG | 19 | 17955151 | - | GGAGAAAGATAGGCGCTGGGGG | 1 | 9 | 159 | SEQ ID NO. 2206 |
| (N20)NGG | 19 | 17955152 | - | AGGAGAAAGATAGGCGCTGGGG | 1 | 3 | 129 | SEQ ID NO. 2207 |
| (N20)NGG | 19 | 17955153 | - | AAGGAGAAAGATAGGCGCTGGG | 1 | 5 | 50 | SEQ ID NO. 2208 |
| (N20)NGG | 19 | 17955154 | - | AAAGGAGAAAGATAGGCGCTGG | 1 | 5 | 45 | SEQ ID NO. 2209 |

FIG. 8 cont.

| site_type | site_chr omosome | site_start_ nucleotide | site_s trand | target_site_sequence_with_NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 19 | 17955155 | - | CAAAGGAGAAAGATAGGCGCTGG | 1 | 2 | 48 | SEQ ID NO. 2210 |
| (N20)NGG | 19 | 17955161 | - | GGTCCCAAAGGAGAAAGATAGG | 1 | 7 | 46 | SEQ ID NO. 2211 |
| (N20)NGG | 19 | 17955172 | - | CTCAGCCAAGTGGTCCCAAAGG | 1 | 5 | 40 | SEQ ID NO. 2212 |
| (N20)NGG | 19 | 17955182 | - | CGCACAGGTCCTCAGCCAAGTGG | 1 | 3 | 20 | SEQ ID NO. 2213 |
| (N20)NGG | 19 | 17955197 | - | CCTTGGCAGCCTGCACGCACAGG | 1 | 5 | 30 | SEQ ID NO. 2214 |
| (N20)NGG | 19 | 17955214 | - | GATGCACTCACCGCTGGCCTTGG | 1 | 1 | 22 | SEQ ID NO. 2215 |
| (N20)NGG | 19 | 17955220 | - | ACTAGGGATGCACTCACCGCTGG | 1 | 2 | 4 | SEQ ID NO. 2216 |

FIG. 8 cont.

| site_type | site_chromosome | site_start_nucleotide | site_strand | target_site_sequence with NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 13 | 108860971 | + | GAACGAATACAGAGAAAAGTAAAGG | 1 | 4 | 132 | SEQ ID NO. 2217 |
| (N20)NGG | 13 | 108860999 | + | CAGAAAAAATCAGACACTTCAGG | 2 | 4 | 102 | SEQ ID NO. 2218 |
| (N20)NGG | 13 | 108861000 | + | AGAAAAAATCAGACACTTCAGGG | 1 | 7 | 193 | SEQ ID NO. 2219 |
| (N20)NGG | 13 | 108861017 | + | TCAGGGAATTTTTAGATTCTTGG | 1 | 4 | 97 | SEQ ID NO. 2220 |
| (N20)NGG | 13 | 108861120 | + | TCAGCTAGAAAGAGAGAGAATGG | 1 | 24 | 320 | SEQ ID NO. 2221 |
| (N20)NGG | 13 | 108861127 | + | GAAAGAGAGAGAATGGCCTATGG | 1 | 9 | 187 | SEQ ID NO. 2222 |
| (N20)NGG | 13 | 108861187 | + | TTGCTTAATTTACCTAGAGATGG | 1 | 3 | 71 | SEQ ID NO. 2223 |
| (N20)NGG | 13 | 108861229 | + | TTAAACTACAGAACACCCACTGG | 1 | 2 | 40 | SEQ ID NO. 2224 |
| (N20)NGG | 13 | 108861238 | + | AGAACACCCACTGGAACTCATGG | 1 | 5 | 43 | SEQ ID NO. 2225 |
| (N20)NGG | 13 | 108861247 | + | ACTGGAACTCATGGAGATGCTGG | 1 | 3 | 54 | SEQ ID NO. 2226 |
| (N20)NGG | 13 | 108861301 | + | AAGCCAAGATGTTTACAGAAAGG | 1 | 8 | 83 | SEQ ID NO. 2227 |
| (N20)NGG | 13 | 108861434 | + | GTTCAGCACTTGAGCAAAAGTGG | 2 | 4 | 30 | SEQ ID NO. 2228 |
| (N20)NGG | 13 | 108861443 | + | TTGAGCAAAAGTGGCTTATACGG | 1 | 1 | 42 | SEQ ID NO. 2229 |
| (N20)NGG | 13 | 108861456 | + | GCTTATACGGATGATCATAAAGG | 1 | 2 | 11 | SEQ ID NO. 2230 |
| (N20)NGG | 13 | 108861469 | + | ATCATAAAGGATTTAAAGCTTGG | 1 | 7 | 76 | SEQ ID NO. 2231 |
| (N20)NGG | 13 | 108861543 | + | GCATAATGTCACTACAGATCTGG | 1 | 2 | 17 | SEQ ID NO. 2232 |
| (N20)NGG | 13 | 108861557 | + | CAGATCTGGAAAAAGTCTGTAGG | 1 | 5 | 67 | SEQ ID NO. 2233 |
| (N20)NGG | 13 | 108861580 | + | CAACTGCATGATCCTTCTGTAGG | 1 | 3 | 22 | SEQ ID NO. 2234 |
| (N20)NGG | 13 | 108861663 | + | AGATATTGAGCACATTGAGAAGG | 1 | 3 | 47 | SEQ ID NO. 2235 |
| (N20)NGG | 13 | 108861706 | + | TACATAGAAACCAAGCTAGATGG | 1 | 3 | 65 | SEQ ID NO. 2236 |
| (N20)NGG | 13 | 108861733 | + | CGTATGCAAATGCACAAAGATGG | 1 | 6 | 63 | SEQ ID NO. 2237 |
| (N20)NGG | 13 | 108861763 | + | TATAAATACTTCTCTCGAAATGG | 1 | 3 | 55 | SEQ ID NO. 2238 |
| (N20)NGG | 13 | 108861787 | + | TATAACTACACTGATCAGTTTGG | 1 | 3 | 28 | SEQ ID NO. 2239 |
| (N20)NGG | 13 | 108861805 | + | TTTGGTGCTTCTCCTACTCGAAGG | 1 | 3 | 41 | SEQ ID NO. 2240 |
| (N20)NGG | 13 | 108861868 | + | ATACAAATCTGTATTCTTGATGG | 1 | 4 | 80 | SEQ ID NO. 2241 |
| (N20)NGG | 13 | 108861879 | + | TATTCTTGATGGTGAGATGATGG | 1 | 5 | 52 | SEQ ID NO. 2242 |
| (N20)NGG | 13 | 108861915 | + | TACACAAACTTTCATGCAAAAGG | 1 | 6 | 92 | SEQ ID NO. 2243 |
| (N20)NGG | 13 | 108861916 | + | ACACAAACTTTCATGCAAAAGGG | 1 | 9 | 109 | SEQ ID NO. 2244 |
| (N20)NGG | 13 | 108861942 | + | TAAGTTTGATATTAAAAGAATGG | 1 | 13 | 223 | SEQ ID NO. 2245 |
| (N20)NGG | 13 | 108861948 | + | TGATATTAAAAGAATGTAGAGG | 1 | 7 | 109 | SEQ ID NO. 2246 |
| (N20)NGG | 13 | 108861993 | + | TTGTGTTTTTGATGTATTGATGG | 1 | 8 | 188 | SEQ ID NO. 2247 |
| (N20)NGG | 13 | 108862012 | + | ATGGTTAATAATAAAAAGCTAGG | 1 | 10 | 140 | SEQ ID NO. 2248 |
| (N20)NGG | 13 | 108862013 | + | TGGTTAATAATAAAAAGCTAGGG | 1 | 5 | 129 | SEQ ID NO. 2249 |
| (N20)NGG | 13 | 108862034 | + | GGCATGAGACTCTGAGAAAGAGG | 2 | 6 | 82 | SEQ ID NO. 2250 |

FIG. 9

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 13 | 108862072 | + | AGTATTTTACACCAATTCCAGG |   | 2 | 2 | 72 SEQ ID NO. 2251 |
| (N20)NGG | 13 | 108862161 | + | AGCAATAGATAAAGAGAAGAGAG |   | 1 | 13 | 203 SEQ ID NO. 2252 |
| (N20)NGG | 13 | 108862162 | + | GCAATAGATAAAGAGAAGAGGG |   | 2 | 13 | 232 SEQ ID NO. 2253 |
| (N20)NGG | 13 | 108862170 | + | TAAAAGAGAAGAGGGAATTATGG |   | 1 | 13 | 241 SEQ ID NO. 2254 |
| (N20)NGG | 13 | 108862210 | + | ATCTACAAGCCAGACAAAAGAGAG |   | 2 | 10 | 219 SEQ ID NO. 2255 |
| (N20)NGG | 13 | 108862216 | + | AAGCCACACAAAAGAGGTGAAGG |   | 2 | 13 | 147 SEQ ID NO. 2256 |
| (N20)NGG | 13 | 108862217 | + | AGCCAGACAAAAGAGGTGAAGGG |   | 1 | 7 | 94 SEQ ID NO. 2257 |
| (N20)NGG | 13 | 108862220 | + | CAGACAAAAGAGGTGAACGGTGG |   | 1 | 5 | 107 SEQ ID NO. 2258 |
| (N20)NGG | 13 | 108862249 | + | ATTAAACCAGAGTATGTCAGTGG |   | 1 | 4 | 25 SEQ ID NO. 2259 |
| (N20)NGG | 13 | 108862257 | + | AGAGTATGTCAGTGGACTAATGG |   | 1 | 3 | 40 SEQ ID NO. 2260 |
| (N20)NGG | 13 | 108862266 | + | CAGTGGACTAATGGATGAATTGG |   | 2 | 6 | 92 SEQ ID NO. 2261 |
| (N20)NGG | 13 | 108862282 | + | GAATTGGACATTTTAATTGTTGG |   | 1 | 8 | 108 SEQ ID NO. 2262 |
| (N20)NGG | 13 | 108862285 | + | TTGGACATTTTAATTGTTGGAGG |   | 1 | 5 | 89 SEQ ID NO. 2263 |
| (N20)NGG | 13 | 108862292 | + | TTTTAATTGTTGGAGGATATTGG |   | 1 | 3 | 107 SEQ ID NO. 2264 |
| (N20)NGG | 13 | 108862293 | + | TTTAATTGTTGGAGGATATTGGG |   | 1 | 7 | 118 SEQ ID NO. 2265 |
| (N20)NGG | 13 | 108862294 | + | TTAATTGTTGGAGGATATTGGGG |   | 1 | 4 | 60 SEQ ID NO. 2266 |
| (N20)NGG | 13 | 108862300 | + | GTTGGAGGATATTGGGGTAAAGG |   | 1 | 4 | 35 SEQ ID NO. 2267 |
| (N20)NGG | 13 | 108862307 | + | GATATTGGGGTAAAGGATCACGG |   | 1 | 2 | 25 SEQ ID NO. 2268 |
| (N20)NGG | 13 | 108862308 | + | ATATTGGGGTAAAGGATCACGGG |   | 1 | 3 | 23 SEQ ID NO. 2269 |
| (N20)NGG | 13 | 108862309 | + | TATTGGGGTAAAGGATCACGGGG |   | 1 | 2 | 16 SEQ ID NO. 2270 |
| (N20)NGG | 13 | 108862312 | + | TGGGGTAAAGGATCACGGGGTGG |   | 1 | 2 | 18 SEQ ID NO. 2271 |
| (N20)NGG | 13 | 108862360 | + | GTAGCAGAAGCCCCTCCTCCTGG |   | 1 | 2 | 35 SEQ ID NO. 2272 |
| (N20)NGG | 13 | 108862399 | + | TTTCATACTCTCTCTCGTGTTGG |   | 1 | 2 | 23 SEQ ID NO. 2273 |
| (N20)NGG | 13 | 108862400 | + | TTCATACTCTCTCTCGTGTTGGG |   | 1 | 1 | 30 SEQ ID NO. 2274 |
| (N20)NGG | 13 | 108862405 | + | ACTCTCTCTCGTGTTGGGTCTGG |   | 1 | 1 | 13 SEQ ID NO. 2275 |
| (N20)NGG | 13 | 108862434 | + | CATGAAAGAACTGTATGATCTGG |   | 1 | 2 | 41 SEQ ID NO. 2276 |
| (N20)NGG | 13 | 108862435 | + | ATGAAAGAACTGTATGATCTGG |   | 1 | 4 | 76 SEQ ID NO. 2277 |
| (N20)NGG | 13 | 108862446 | + | GTATGATCTGGGTTTGAAATTGG |   | 1 | 2 | 51 SEQ ID NO. 2278 |
| (N20)NGG | 13 | 108862457 | + | GTTTGAAATTGGCCAAGTATTGG |   | 1 | 5 | 44 SEQ ID NO. 2279 |
| (N20)NGG | 13 | 108862501 | + | CCACCAAGCAGCATTTTATGTGG |   | 1 | 3 | 44 SEQ ID NO. 2280 |
| (N20)NGG | 13 | 108862597 | + | CCCAGTGATATGTATAAAACTGG |   | 1 | 4 | 34 SEQ ID NO. 2281 |
| (N20)NGG | 13 | 108862644 | + | TGAAAAGATAAGAGATGACAAGG |   | 1 | 10 | 202 SEQ ID NO. 2282 |
| (N20)NGG | 13 | 108862649 | + | AGATAAGAGATGACAAGGAGTGG |   | 2 | 11 | 152 SEQ ID NO. 2283 |
| (N20)NGG | 13 | 108862668 | + | GTGGCATGAGTGCATGACCCTGG |   | 1 | 1 | 50 SEQ ID NO. 2284 |

FIG. 9 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 13 | 108862688 | + | TGGACGACCTAGAACAACTTAGG | | 2 | 8 | SEQ ID NO. | 2285 |
| (N20)NGG | 13 | 108862689 | + | GGACGACCTAGAACAACTTAGGG | | 2 | 6 | SEQ ID NO. | 2286 |
| (N20)NGG | 13 | 108862690 | + | GACGACCTAGAACAACTTAGGGG | | 1 | 12 | SEQ ID NO. | 2287 |
| (N20)NGG | 13 | 108862691 | + | ACGACCTAGAACAACTTAGGGGG | | 1 | 14 | SEQ ID NO. | 2288 |
| (N20)NGG | 13 | 108862695 | + | CCTAGAACAACTTAGGGGGAAGG | | 1 | 21 | SEQ ID NO. | 2289 |
| (N20)NGG | 13 | 108862702 | + | CAACTTAGGGGGAAGGCATCTGG | | 4 | 59 | SEQ ID NO. | 2290 |
| (N20)NGG | 13 | 108862732 | + | GCATCTAAACACCTTTATATAGG | 1 | 4 | 38 | SEQ ID NO. | 2291 |
| (N20)NGG | 13 | 108862735 | + | TCTAAACACCTTTATATAGGTGG | 1 | 2 | 40 | SEQ ID NO. | 2292 |
| (N20)NGG | 13 | 108862763 | + | ATGAACCACAAGAAAAAAAGCGG | 1 | 8 | 286 | SEQ ID NO. | 2293 |
| (N20)NGG | 13 | 108862795 | + | CCAAAGATGAAGAAAAGTTATTGG | 1 | 10 | 120 | SEQ ID NO. | 2294 |
| (N20)NGG | 13 | 108862885 | + | GTAGAGTTTTGTGTTATGAGTGG | 1 | 2 | 38 | SEQ ID NO. | 2295 |
| (N20)NGG | 13 | 108862914 | + | TAGCCAGCCAAAGCCTGACCTGG | 1 | 2 | 19 | SEQ ID NO. | 2296 |
| (N20)NGG | 13 | 108862936 | + | GAGAACAGAATTGCAGAATTTGG | 1 | 8 | 110 | SEQ ID NO. | 2297 |
| (N20)NGG | 13 | 108862939 | + | AACAGAATTGCAGAATTTGGTGG | 1 | 6 | 106 | SEQ ID NO. | 2298 |
| (N20)NGG | 13 | 108862960 | + | GGTTATATAGTACAAAATCCAGG | 1 | 2 | 21 | SEQ ID NO. | 2299 |
| (N20)NGG | 13 | 108862987 | + | GACACGTACTGTGTAATTGCAGG | 1 | 1 | 13 | SEQ ID NO. | 2300 |
| (N20)NGG | 13 | 108862988 | + | ACACGTACTGTGTAATTGCAGGG | 1 | 2 | 19 | SEQ ID NO. | 2301 |
| (N20)NGG | 13 | 108863054 | + | ATGATGTTGTCAAGCCTGCATGG | 1 | 5 | 38 | SEQ ID NO. | 2302 |
| (N20)NGG | 13 | 108863093 | + | AGAACAAAAGCTTTGTACCATGG | 1 | 3 | 40 | SEQ ID NO. | 2303 |
| (N20)NGG | 13 | 108863164 | + | GCCCGTGAATATGATTGCTATGG | 1 | 2 | 7 | SEQ ID NO. | 2304 |
| (N20)NGG | 13 | 108863205 | + | TACAGACTTGAACCAACTGAAGG | 1 | 1 | 38 | SEQ ID NO. | 2305 |
| (N20)NGG | 13 | 108863218 | + | CAACTGAAGGAAGTATTCTCAGG | 1 | 2 | 41 | SEQ ID NO. | 2306 |
| (N20)NGG | 13 | 108863256 | + | CGAGCAGACTCCTGAAGAAATGG | 1 | 2 | 37 | SEQ ID NO. | 2307 |
| (N20)NGG | 13 | 108863285 | + | TGATTGCTGATTTAGAATATCGG | 1 | 4 | 88 | SEQ ID NO. | 2308 |
| (N20)NGG | 13 | 108863294 | + | ATTTAGAATATCGGTATTCCTGG | 1 | 1 | 18 | SEQ ID NO. | 2309 |
| (N20)NGG | 13 | 108863295 | + | TTTAGAATATCGGTATTCCTGGG | 1 | 2 | 27 | SEQ ID NO. | 2310 |
| (N20)NGG | 13 | 108863340 | + | TCGACGCCACACCGTTTATTTGG | 1 | 1 | 2 | SEQ ID NO. | 2311 |
| (N20)NGG | 13 | 108863382 | + | TGACCTGAGTACCAAAAATGAGG | 1 | 3 | 33 | SEQ ID NO. | 2312 |
| (N20)NGG | 13 | 108863383 | + | GACCTGAGTACCAAAAATGAGGG | 1 | 2 | 32 | SEQ ID NO. | 2313 |
| (N20)NGG | 13 | 108863384 | + | ACCTGAGTACCAAAAATGAGGGG | 1 | 5 | 34 | SEQ ID NO. | 2314 |
| (N20)NGG | 13 | 108863390 | + | GTACCAAAAATGAGGGGACAAGG | 2 | 2 | 41 | SEQ ID NO. | 2315 |
| (N20)NGG | 13 | 108863409 | + | AAGGTTAGCTATTAAAGCCTTGG | 1 | 4 | 27 | SEQ ID NO. | 2316 |
| (N20)NGG | 13 | 108863417 | + | CTATTAAAGCCTTCGAGCTTCGG | 1 | 2 | 31 | SEQ ID NO. | 2317 |
| (N20)NGG | 13 | 108863425 | + | GCCTTGGAGCTTCGGTTTCATGG | 1 | 3 | 18 | SEQ ID NO. | 2318 |

FIG. 9 cont.

| site type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 13 | 108863454 | + | AGTAGTTTCTTCTTGTTTAGCTGAGG | 1 | 5 | 47 | SEQ ID NO. 2319 |
| (N20)NGG | 13 | 108863455 | + | GTAGTTTCTTCTTGTTTAGCTGAGGG | 1 | 4 | 51 | SEQ ID NO. 2320 |
| (N20)NGG | 13 | 108863476 | + | GGAGTGTCTCATGTAATAATAATTGG | 1 | 2 | 29 | SEQ ID NO. 2321 |
| (N20)NGG | 13 | 108863477 | + | GAGTGTCTCATGTAATAATAATTGGG | 1 | 7 | 48 | SEQ ID NO. 2322 |
| (N20)NGG | 13 | 108863478 | + | AGTGTCTCATGTAATAATAATTGGGG | 1 | 6 | 62 | SEQ ID NO. 2323 |
| (N20)NGG | 13 | 108863558 | + | TTAAAATCCTAAAAGAAAGTTGG | 2 | 22 | 272 | SEQ ID NO. 2324 |
| (N20)NGG | 13 | 108863559 | + | TAAAATCCTAAAAGAAAGTTTGG | 2 | 14 | 269 | SEQ ID NO. 2325 |
| (N20)NGG | 13 | 108860887 | - | AACAGTTTGTGAAGTTTGTGAGG | 1 | 6 | 80 | SEQ ID NO. 2326 |
| (N20)NGG | 13 | 108860922 | - | GTTGAACACAAATCTGCAAAAGG | 1 | 6 | 72 | SEQ ID NO. 2327 |
| (N20)NGG | 13 | 108861047 | - | AAGAGTCTGTGACATCTTTGTGG | 1 | 5 | 70 | SEQ ID NO. 2328 |
| (N20)NGG | 13 | 108861075 | - | GGAAGAATTAGTCTCATTGCTGG | 1 | 2 | 28 | SEQ ID NO. 2329 |
| (N20)NGG | 13 | 108861096 | - | ATTCTCTCTCTTTCTTAGCTGAGG | 1 | 10 | 144 | SEQ ID NO. 2330 |
| (N20)NGG | 13 | 108861121 | - | CATAGTTTCTTTAATTCCATAGG | 1 | 15 | 131 | SEQ ID NO. 2331 |
| (N20)NGG | 13 | 108861177 | - | AGGGCATCTTTTCCATCTCTAGG | 1 | 4 | 72 | SEQ ID NO. 2332 |
| (N20)NGG | 13 | 108861196 | - | TCTGTAGTTTAAAAGTTTGACGG | 1 | 14 | 139 | SEQ ID NO. 2333 |
| (N20)NGG | 13 | 108861197 | - | TTCTGTAGTTTAAAAGTTTCAGG | 1 | 12 | 235 | SEQ ID NO. 2334 |
| (N20)NGG | 13 | 108861222 | - | GCATCTCCATGAGTTCCAGTGG | 1 | 1 | 33 | SEQ ID NO. 2335 |
| (N20)NGG | 13 | 108861223 | - | AGCATCTCCATGAGTTCCAGTGG | 1 | 4 | 57 | SEQ ID NO. 2336 |
| (N20)NGG | 13 | 108861282 | - | CTTCCTTTCTGTAAACATCTTGG | 2 | 9 | 100 | SEQ ID NO. 2337 |
| (N20)NGG | 13 | 108861310 | - | AAGTCGTTTACTTGCTGTATGG | 1 | 1 | 14 | SEQ ID NO. 2338 |
| (N20)NGG | 13 | 108861329 | - | TGCTGGCAATTGAGTCTAAAAGG | 1 | 2 | 27 | SEQ ID NO. 2339 |
| (N20)NGG | 13 | 108861346 | - | TCTTTTAGCAGAATTATTGCTGG | 1 | 5 | 61 | SEQ ID NO. 2340 |
| (N20)NGG | 13 | 108861374 | - | GAAGAAGGCTCTTTTTTATTAGG | 1 | 4 | 98 | SEQ ID NO. 2341 |
| (N20)NGG | 13 | 108861389 | - | TCTGAGTTATAAGTTGAAGAAGG | 1 | 2 | 58 | SEQ ID NO. 2342 |
| (N20)NGG | 13 | 108861570 | - | ATATCACTGAGTCCTACAGAAGG | 2 | 4 | 39 | SEQ ID NO. 2343 |
| (N20)NGG | 13 | 108861621 | - | TCTCAATAGCAGCTAGCATTGG | 2 | 1 | 31 | SEQ ID NO. 2344 |
| (N20)NGG | 13 | 108861694 | - | CATAGCTTCACCATCTAGCTTGG | 1 | 1 | 15 | SEQ ID NO. 2345 |
| (N20)NGG | 13 | 108861795 | - | GGGGTAAGAGAACCTTCAGTAGG | 1 | 1 | 18 | SEQ ID NO. 2346 |
| (N20)NGG | 13 | 108861814 | - | GAATGCATTATGAATGAATGGGG | 2 | 21 | 230 | SEQ ID NO. 2347 |
| (N20)NGG | 13 | 108861815 | - | TGAATGCATTATGAATGAATGGG | 2 | 32 | 329 | SEQ ID NO. 2348 |
| (N20)NGG | 13 | 108861816 | - | TTGAATGCATTATGAATGAATGG | 1 | 10 | 174 | SEQ ID NO. 2349 |
| (N20)NGG | 13 | 108861880 | - | AGTTTGTGTATTAGGATTATAGG | 1 | 3 | 41 | SEQ ID NO. 2350 |
| (N20)NGG | 13 | 108861888 | - | TGCATGAAAGTTTCTGTATTAGG | 1 | 5 | 76 | SEQ ID NO. 2351 |
| (N20)NGG | 13 | 108862062 | - | ATTTCTATTCTACCTGGAATTGG | 1 | 5 | 154 | SEQ ID NO. 2352 |

FIG. 9 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 13 | 108862068 | - | TGCACTATTTCTATTCTACCTGG | 1 | 4 | 37 | SEQ ID NO. 2353 |
| (N20)NGG | 13 | 108862179 | - | TCTGGCTTGTAGAATGGATAGAGG | 1 | 5 | 35 | SEQ ID NO. 2354 |
| (N20)NGG | 13 | 108862186 | - | TCTTTTGTCTGGCTTGTAGATGG | 1 | 4 | 81 | SEQ ID NO. 2355 |
| (N20)NGG | 13 | 108862197 | - | CACCCTTCACCTCTTTTGTCTGG | 1 | 8 | 33 | SEQ ID NO. 2356 |
| (N20)NGG | 13 | 108862233 | - | ATTAGTCCACTGACATACTCTGG | 1 | 2 | 24 | SEQ ID NO. 2357 |
| (N20)NGG | 13 | 108862350 | - | GATGGCTTCTCACCAGGAGGGG | 1 | 9 | 121 | SEQ ID NO. 2358 |
| (N20)NGG | 13 | 108862351 | - | AGATGGCTTCTCACCAGGAGGG | 1 | 4 | 53 | SEQ ID NO. 2359 |
| (N20)NGG | 13 | 108862352 | - | CAGATGGCTTCTCACCAGGAGG | 2 | 8 | 60 | SEQ ID NO. 2360 |
| (N20)NGG | 13 | 108862353 | - | ACAGATGGCTTCTCACCAGGAGG | 2 | 5 | 74 | SEQ ID NO. 2361 |
| (N20)NGG | 13 | 108862356 | - | AACACAGATGGCTTCTCACCAGG | 1 | 5 | 49 | SEQ ID NO. 2362 |
| (N20)NGG | 13 | 108862368 | - | GAGAGAGTATGAAACACAGATGG | 1 | 15 | 279 | SEQ ID NO. 2363 |
| (N20)NGG | 13 | 108862411 | - | CAGATCATACAGTTCTTTCATGG | 1 | 5 | 51 | SEQ ID NO. 2364 |
| (N20)NGG | 13 | 108862447 | - | ATGAAAAGGCTTTCTCCAATACTTGG | 1 | 1 | 36 | SEQ ID NO. 2365 |
| (N20)NGG | 13 | 108862461 | - | GGTGAGCTTTTCTATGAAAAGG | 1 | 4 | 45 | SEQ ID NO. 2366 |
| (N20)NGG | 13 | 108862479 | - | CCACATAAAATCTGCTTGTGTGG | 1 | 2 | 44 | SEQ ID NO. 2367 |
| (N20)NGG | 13 | 108862482 | - | GTTCCACATAAAATGCTGCTTGG | 1 | 2 | 44 | SEQ ID NO. 2368 |
| (N20)NGG | 13 | 108862512 | - | CAAGGTTCAATGTATACTTCTGG | 1 | 2 | 24 | SEQ ID NO. 2369 |
| (N20)NGG | 13 | 108862530 | - | TGAACAATGACAGAATTACAAGG | 1 | 8 | 103 | SEQ ID NO. 2370 |
| (N20)NGG | 13 | 108862575 | - | CCAGTTTTATACATATCACTGGG | 1 | 3 | 54 | SEQ ID NO. 2371 |
| (N20)NGG | 13 | 108862576 | - | GCCAGTTTTATACATATCACTGG | 1 | 2 | 26 | SEQ ID NO. 2372 |
| (N20)NGG | 13 | 108862603 | - | TTCAATTCGTGAAAACGCAAGG | 1 | 2 | 13 | SEQ ID NO. 2373 |
| (N20)NGG | 13 | 108862614 | - | TCTCTTATCTTTTCAATTCGTGG | 1 | 3 | 54 | SEQ ID NO. 2374 |
| (N20)NGG | 13 | 108862663 | - | AAGTTGTTCTAGGTCGTCAGGG | 1 | 2 | 9 | SEQ ID NO. 2375 |
| (N20)NGG | 13 | 108862664 | - | TAAGTTGTTCTAGGTCGTCCAGG | 1 | 1 | 8 | SEQ ID NO. 2376 |
| (N20)NGG | 13 | 108862673 | - | CCTTCCCCCTAAGTTGTTCTAGG | 1 | 4 | 40 | SEQ ID NO. 2377 |
| (N20)NGG | 13 | 108862721 | - | CATCATCACCACCTATATAAAGG | 1 | 6 | 43 | SEQ ID NO. 2378 |
| (N20)NGG | 13 | 108862746 | - | GCTTTTCCGCTTTTTTTTCTTGTGG | 1 | 4 | 72 | SEQ ID NO. 2379 |
| (N20)NGG | 13 | 108862771 | - | AATAACTTTCTTCTTCATCTTTGGGG | 3 | 14 | 170 | SEQ ID NO. 2380 |
| (N20)NGG | 13 | 108862772 | - | CAATAACTTTCTTCTTCATCTTTGG | 1 | 13 | 151 | SEQ ID NO. 2381 |
| (N20)NGG | 13 | 108862773 | - | CCAATAACTTTCTTCTTCATCTTGG | 1 | 5 | 82 | SEQ ID NO. 2382 |
| (N20)NGG | 13 | 108862818 | - | TTGTTAACGTTAGTAAGGTTAGG | 1 | 2 | 14 | SEQ ID NO. 2383 |
| (N20)NGG | 13 | 108862823 | - | AAATTTTGTTAACGTTAGTAAGG | 1 | 3 | 83 | SEQ ID NO. 2384 |
| (N20)NGG | 13 | 108862895 | - | TCTCCAGGTCAGGCTTTGGCTGG | 1 | 2 | 36 | SEQ ID NO. 2385 |
| (N20)NGG | 13 | 108862899 | - | CTGTTCTCCAGGTCAGGCTTTGG | 1 | 4 | 47 | SEQ ID NO. 2386 |

FIG. 9 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 13 | 108862905 | - | GCAATTCTGTTCTCCAGGTCAGG | 1 | 4 | 30 | SEQ ID NO. 2387 |
| (N20)NGG | 13 | 108862910 | - | ATTCTGCAATTCTGTTCTCCAGG | 1 | 4 | 92 | SEQ ID NO. 2388 |
| (N20)NGG | 13 | 108862956 | - | ACACAGTACGTCTGGGCCTGG | 1 | 3 | 21 | SEQ ID NO. 2389 |
| (N20)NGG | 13 | 108862961 | - | CAATTACACAGTACGTGTCTGGG | 1 | 2 | 21 | SEQ ID NO. 2390 |
| (N20)NGG | 13 | 108862962 | - | GCAATTACACAGTACGTGTCTGG | 1 | 2 | 12 | SEQ ID NO. 2391 |
| (N20)NGG | 13 | 108863046 | - | AAACATTCTAAAAGCCATGCAGG | 2 | 3 | 51 | SEQ ID NO. 2392 |
| (N20)NGG | 13 | 108863074 | - | CTGCCATGGTACAAAGCTTTTGG | 1 | 5 | 31 | SEQ ID NO. 2393 |
| (N20)NGG | 13 | 108863088 | - | ATCATAAAGCGAGGCTGCCATGG | 1 | 2 | 14 | SEQ ID NO. 2394 |
| (N20)NGG | 13 | 108863097 | - | CACATATGAATCATAAAGCGAGG | 1 | 1 | 22 | SEQ ID NO. 2395 |
| (N20)NGG | 13 | 108863120 | - | CAAAATGTTCTTTGGTTGATGGG | 1 | 2 | 84 | SEQ ID NO. 2396 |
| (N20)NGG | 13 | 108863121 | - | GCAAAATGTTCTTTGGTTGATGG | 1 | 8 | 77 | SEQ ID NO. 2397 |
| (N20)NGG | 13 | 108863128 | - | TTCACGGGCAAAATGTTCTTTGG | 1 | 5 | 19 | SEQ ID NO. 2398 |
| (N20)NGG | 13 | 108863143 | - | ACCATAGCAATCATATTCACGGG | 1 | 2 | 26 | SEQ ID NO. 2399 |
| (N20)NGG | 13 | 108863144 | - | CACCATAGCAATCATATTCACGG | 1 | 1 | 44 | SEQ ID NO. 2400 |
| (N20)NGG | 13 | 108863195 | - | CTGAGAATACTTCCTTCAGTTGG | 1 | 4 | 48 | SEQ ID NO. 2401 |
| (N20)NGG | 13 | 108863244 | - | ATCAGAGAAGCCATTTCTTCAGG | 1 | 2 | 79 | SEQ ID NO. 2402 |
| (N20)NGG | 13 | 108863290 | - | ACTGAGAGGAGAGCAATCCCAGG | 1 | 3 | 43 | SEQ ID NO. 2403 |
| (N20)NGG | 13 | 108863304 | - | TGGCGTCGAAACATACTGAGAGG | 1 | 2 | 3 | SEQ ID NO. 2404 |
| (N20)NGG | 13 | 108863324 | - | ACGAGTCCAAATAAACGGTGTGG | 1 | 1 | 4 | SEQ ID NO. 2405 |
| (N20)NGG | 13 | 108863329 | - | AGCATACGAGTCCAAATAAACGG | 1 | 1 | 16 | SEQ ID NO. 2406 |
| (N20)NGG | 13 | 108863363 | - | TCCCCTCATTTTTGGTACTCAGG | 1 | 3 | 46 | SEQ ID NO. 2407 |
| (N20)NGG | 13 | 108863371 | - | TAACCTTGTCCCCTCATTTTTGG | 1 | 2 | 42 | SEQ ID NO. 2408 |
| (N20)NGG | 13 | 108863404 | - | TCCATGAAACCGAAGCTCCAAGG | 1 | 3 | 21 | SEQ ID NO. 2409 |
| (N20)NGG | 13 | 108863543 | - | CAGTTACCCAACTTTCTTTTAGG | 1 | 3 | 56 | SEQ ID NO. 2410 |

FIG. 9 cont.

| site_type | site_chr omosome | site_start_ nucleotide | site_s trand | target_site_sequence_with_NGG | genome_wide_hits_with_1_or_less_mism atches | genome_wide_hits_with_2_or_less_mism atches | genome_wide_hits_with_3_or_less_mism atches | | |
|---|---|---|---|---|---|---|---|---|---|
| (N20)NGG | 2 | 219941102 | + | ACTTGGGTTCCCTTTTTTCTAGG | 1 | 3 | 85 | SEQ ID NO. | 2411 |
| (N20)NGG | 2 | 219941103 | + | CTTGGGTTCCCTTTTTTTCTAGGG | 1 | 4 | 98 | SEQ ID NO. | 2412 |
| (N20)NGG | 2 | 219941112 | + | CCTTTTTTCTAGGGTACTTCAGG | 1 | 5 | 42 | SEQ ID NO. | 2413 |
| (N20)NGG | 2 | 219941141 | + | GCAGAGACCTCAGCTGTCAAAGG | 2 | 7 | 49 | SEQ ID NO. | 2414 |
| (N20)NGG | 2 | 219941149 | + | CTCAGCTGTCAAAGGTCAAGAGG | 1 | 5 | 67 | SEQ ID NO. | 2415 |
| (N20)NGG | 2 | 219941161 | + | AGGTCAAGAGGAAGAAGCCAAGG | 1 | 12 | 171 | SEQ ID NO. | 2416 |
| (N20)NGG | 2 | 219941162 | + | GGTCAAGAGGAAGAAGCCAAGGG | 1 | 9 | 103 | SEQ ID NO. | 2417 |
| (N20)NGG | 2 | 219941163 | + | GTCAAGAGGAAGAAGCCAAGGGG | 1 | 6 | 120 | SEQ ID NO. | 2418 |
| (N20)NGG | 2 | 219941186 | + | TCTCTTCAGTTAATCTGTTGTGG | 1 | 2 | 51 | SEQ ID NO. | 2419 |
| (N20)NGG | 2 | 219941201 | + | TGTTGTGGCCTCAGCTGCTGAGG | 2 | 5 | 75 | SEQ ID NO. | 2420 |
| (N20)NGG | 2 | 219941089 | - | CTGAAGTACCCTAGAAAAAAAGG | 2 | 2 | 53 | SEQ ID NO. | 2421 |
| (N20)NGG | 2 | 219941090 | - | CCTGAAGTACCCTAGAAAAAAAG | 1 | 5 | 44 | SEQ ID NO. | 2422 |
| (N20)NGG | 2 | 219941113 | - | ACAGCTGAGGTCTCTGCAGAGG | 1 | 13 | 200 | SEQ ID NO. | 2423 |
| (N20)NGG | 2 | 219941114 | - | GACAGCTGAGGTCTCTGCAGAGG | 3 | 7 | 90 | SEQ ID NO. | 2424 |
| (N20)NGG | 2 | 219941126 | - | CTCTTGACCTTTGACAGCTGAGG | 2 | 5 | 47 | SEQ ID NO. | 2425 |
| (N20)NGG | 2 | 219941156 | - | GATTAACTGAAGAGACCCCTTGG | 1 | 1 | 16 | SEQ ID NO. | 2426 |
| (N20)NGG | 2 | 219941967 | - | CTCTTGATCTTTCTGATTTCAGG | 1 | 5 | 119 | SEQ ID NO. | 2427 |
| (N20)NGG | 2 | 219942003 | + | TCAAACAGTGCTTCCCTGCAAGG | 1 | 3 | 57 | SEQ ID NO. | 2428 |
| (N20)NGG | 2 | 219942041 | + | TGTAAACCAGCCAGAACAACTGG | 1 | 4 | 61 | SEQ ID NO. | 2429 |
| (N20)NGG | 2 | 219942086 | + | AGCACCTGAGAAAGAGTCCACGG | 1 | 2 | 66 | SEQ ID NO. | 2430 |
| (N20)NGG | 2 | 219942108 | + | GTGAGTCATGAGCAGCTTCCTGG | 1 | 1 | 30 | SEQ ID NO. | 2431 |
| (N20)NGG | 2 | 219941972 | - | GAAGCACTGTTGAGGTATGAGG | 1 | 3 | 40 | SEQ ID NO. | 2432 |
| (N20)NGG | 2 | 219941979 | - | TTGCAGGGAAGCACTGTTTGAGG | 1 | 2 | 54 | SEQ ID NO. | 2433 |
| (N20)NGG | 2 | 219941994 | - | TTGGCTATCGATTCCTTGCAGG | 1 | 2 | 7 | SEQ ID NO. | 2434 |
| (N20)NGG | 2 | 219941995 | - | ATTGGCTATCGATTCCTTGCAGG | 1 | 1 | 30 | SEQ ID NO. | 2435 |
| (N20)NGG | 2 | 219942013 | - | GTTCTGGCTGGTTTACACATTGG | 1 | 3 | 38 | SEQ ID NO. | 2436 |
| (N20)NGG | 2 | 219942025 | - | AGGAGACCAGTTGTTCTGGCTGG | 1 | 1 | 31 | SEQ ID NO. | 2437 |
| (N20)NGG | 2 | 219942029 | - | GCTGAGGAGACCAGTTGTTCTGG | 1 | 1 | 23 | SEQ ID NO. | 2438 |
| (N20)NGG | 2 | 219942045 | - | TGCTGAGGGGTTGGGGCTGAGG | 1 | 12 | 181 | SEQ ID NO. | 2439 |
| (N20)NGG | 2 | 219942051 | - | CTCAGGTGCTGAGAGGGTTGGGG | 1 | 7 | 79 | SEQ ID NO. | 2440 |
| (N20)NGG | 2 | 219942052 | - | TCTCAGGTGCTGAGAGGGTTGG | 1 | 2 | 73 | SEQ ID NO. | 2441 |
| (N20)NGG | 2 | 219942053 | - | TTCTCAGGTGCTGAGAGGGTTGG | 1 | 6 | 74 | SEQ ID NO. | 2442 |
| (N20)NGG | 2 | 219942057 | - | CTCTTTCTCAGGTGCTGAGAGGG | 1 | 3 | 80 | SEQ ID NO. | 2443 |
| (N20)NGG | 2 | 219942058 | - | ACTCTTTCTCAGGTGCTGAGAGG | 1 | 2 | 58 | SEQ ID NO. | 2444 |

FIG. 10

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 2 | 219942068 | - | CTCACCGTGGACTCTTTCTCAGG | 1 | 2 | 39 | SEQ ID NO. 2445 |
| (N20)NGG | 2 | 219942081 | - | AAGCTGCTCATGACTCACCGTGG | 1 | 1 | 9 | SEQ ID NO. 2446 |
| (N20)NGG | 2 | 219942822 | + | TCTCTTACAGAAACTGCCAGAGG | 1 | 5 | 60 | SEQ ID NO. 2447 |
| (N20)NGG | 2 | 219942835 | + | CTGCCAGAGGCATGCAGCATTGG | 1 | 2 | 42 | SEQ ID NO. 2448 |
| (N20)NGG | 2 | 219942841 | + | GAGGCATGCAGCATTGGTGATGG | 1 | 6 | 90 | SEQ ID NO. 2449 |
| (N20)NGG | 2 | 219942867 | + | GCCCTTTGTCATGAATCTGCAGG | 1 | 2 | 33 | SEQ ID NO. 2450 |
| (N20)NGG | 2 | 219942879 | + | GAATCTGCAGGATCTGTATATGG | 1 | 5 | 31 | SEQ ID NO. 2451 |
| (N20)NGG | 2 | 219942897 | + | TATGGCAGTCACCACACAAGAGG | 1 | 3 | 28 | SEQ ID NO. 2452 |
| (N20)NGG | 2 | 219942906 | + | CACCACACAAGAGGTCCAAGTGG | 1 | 2 | 32 | SEQ ID NO. 2453 |
| (N20)NGG | 2 | 219942907 | + | ACCACACAAGAGGTCCAAGTGGG | 1 | 2 | 30 | SEQ ID NO. 2454 |
| (N20)NGG | 2 | 219942922 | + | CAAGTGGGACAGAAGCATCAAGG | 1 | 3 | 52 | SEQ ID NO. 2455 |
| (N20)NGG | 2 | 219942928 | + | GGACAAGAGCATCAAGGCGCTGG | 1 | 2 | 24 | SEQ ID NO. 2456 |
| (N20)NGG | 2 | 219942943 | + | GGCGCTGGTGAGCCCTCCAGAGG | 1 | 1 | 30 | SEQ ID NO. 2457 |
| (N20)NGG | 2 | 219942950 | + | GTGAGCCCTCCAGAGGTACCCGG | 1 | 1 | 23 | SEQ ID NO. 2458 |
| (N20)NGG | 2 | 219942796 | - | TGGCAGTTTCTGTAAGAGAGAGG | 1 | 3 | 78 | SEQ ID NO. 2459 |
| (N20)NGG | 2 | 219942816 | - | TCACCAATGCTGCATGCCTCTGG | 1 | 2 | 32 | SEQ ID NO. 2460 |
| (N20)NGG | 2 | 219942846 | - | TCCTGCAGATTCATGACAAAGGG | 1 | 2 | 47 | SEQ ID NO. 2461 |
| (N20)NGG | 2 | 219942847 | - | ATCCTGCAGATTCATGACAAAGG | 1 | 2 | 32 | SEQ ID NO. 2462 |
| (N20)NGG | 2 | 219942886 | - | TCCCACTTGGACCTCTTGTGTGG | 1 | 2 | 60 | SEQ ID NO. 2463 |
| (N20)NGG | 2 | 219942899 | - | CTTGATGCTTCTGTCCCACTTGG | 1 | 3 | 31 | SEQ ID NO. 2464 |
| (N20)NGG | 2 | 220011442 | + | ATTTGAAGAAAATTCCTTCTTGG | 1 | 15 | 228 | SEQ ID NO. 2465 |
| (N20)NGG | 2 | 220011460 | + | CTTGGAACAATTTATGATAGAGG | 1 | 5 | 45 | SEQ ID NO. 2466 |
| (N20)NGG | 2 | 220011465 | + | AACAATTTATGATAGAGGTAAGG | 1 | 2 | 83 | SEQ ID NO. 2467 |
| (N20)NGG | 2 | 220011387 | - | TCAATCGATCTGTAATAAGAAGG | 1 | 1 | 25 | SEQ ID NO. 2468 |
| (N20)NGG | 2 | 220011418 | - | AAGAAGGAATTTTCTTCAAAATGG | 1 | 16 | 274 | SEQ ID NO. 2469 |
| (N20)NGG | 2 | 220011434 | - | TATCATAAATTGTTCCAAGAAGG | 1 | 5 | 55 | SEQ ID NO. 2470 |
| (N20)NGG | 2 | 220012378 | + | ATTGATATATCTCTTCCCTCAAGG | 1 | 1 | 67 | SEQ ID NO. 2471 |
| (N20)NGG | 2 | 220012408 | + | ACATTTGATTCGTCCTCTGATGG | 1 | 2 | 14 | SEQ ID NO. 2472 |
| (N20)NGG | 2 | 220012409 | + | CATTTGATTCGTCCTCTGATGGG | 1 | 3 | 17 | SEQ ID NO. 2473 |
| (N20)NGG | 2 | 220012420 | + | TCCTCTGATGGGCATGAGTCTGG | 1 | 1 | 44 | SEQ ID NO. 2474 |
| (N20)NGG | 2 | 220012440 | + | TGGCATTACAGTGCCAAGTGAGG | 1 | 4 | 37 | SEQ ID NO. 2475 |
| (N20)NGG | 2 | 220012441 | + | GGCATTACAGTGCCAAGTGAGGG | 1 | 1 | 26 | SEQ ID NO. 2476 |
| (N20)NGG | 2 | 220012492 | + | CCTAGAGATCCAAGACTACCAGG | 1 | 1 | 12 | SEQ ID NO. 2477 |
| (N20)NGG | 2 | 220012499 | + | ATCCAAGACTACCAGGAGAGTGG | 1 | 4 | 42 | SEQ ID NO. 2478 |

FIG. 10 cont.

| site_type | site_chr omosome | site_start_ nucleotide | site_s trand | target_site_sequence_wit h_NGG | genome_wide_ hits_with_1_ or_less_mism atches | genome_wide_ hits_with_2_ or_less_mism atches | genome_wide_ hits_with_3_ or_less_mism atches | |
|---|---|---|---|---|---|---|---|---|
| (N20)NGG | 2 | 220012500 | + | TCCAAGACTACCAGGAGAGTGGG | | 1 | 6 | 44 SEQ ID NO. 2479 |
| (N20)NGG | 2 | 220012501 | + | CCAAGACTACCAGGAGAGTGGGG | | 2 | 4 | 44 SEQ ID NO. 2480 |
| (N20)NGG | 2 | 220012517 | + | AGTGGGCTACGCTGATTCGAGG | | 1 | 1 | 5 SEQ ID NO. 2481 |
| (N20)NGG | 2 | 220012524 | + | CTACGCTGATTCGAGTAAGAGG | | 1 | 1 | 5 SEQ ID NO. 2482 |
| (N20)NGG | 2 | 220012534 | + | TCGAGGTAAGAGGACATTCTTGG | | 1 | 2 | 55 SEQ ID NO. 2483 |
| (N20)NGG | 2 | 220012537 | + | AGGTAAGAGGACATTCTTGGAGG | | 1 | 3 | 66 SEQ ID NO. 2484 |
| (N20)NGG | 2 | 220012369 | - | AAATGTTGGGAGACCTTTGAGG | | 1 | 5 | 66 SEQ ID NO. 2485 |
| (N20)NGG | 2 | 220012370 | - | CAAATGTTGGGAGACCTTTGAGG | | 1 | 2 | 43 SEQ ID NO. 2486 |
| (N20)NGG | 2 | 220012382 | - | CAGAGGACGAATCAAATGTTGGG | | 1 | 3 | 22 SEQ ID NO. 2487 |
| (N20)NGG | 2 | 220012383 | - | TCAGAGGACGAATCAAATGTTGG | | 1 | 2 | 23 SEQ ID NO. 2488 |
| (N20)NGG | 2 | 220012399 | - | GCCAGACTCATGCCCATCAGAGG | | 1 | 3 | 33 SEQ ID NO. 2489 |
| (N20)NGG | 2 | 220012431 | - | ACGTTGCTAGCTCCCTCACTTGG | | 1 | 2 | 16 SEQ ID NO. 2490 |
| (N20)NGG | 2 | 220012470 | - | CCTGGTAGTCTTGGATCTCTAGG | | 1 | 1 | 25 SEQ ID NO. 2491 |
| (N20)NGG | 2 | 220012479 | - | CCCCACTTCCTCGGTAGTCTTGG | | 1 | 5 | 37 SEQ ID NO. 2492 |
| (N20)NGG | 2 | 220012488 | - | TCAGCGTAGCCCCACTTCCTCGG | | 1 | 3 | 63 SEQ ID NO. 2493 |
| (N20)NGG | 2 | 220022193 | + | TGTACCACTGCTCTCTCTTTAGG | | 1 | 6 | 57 SEQ ID NO. 2494 |
| (N20)NGG | 2 | 220022207 | + | CTCTTTAGGAGCTGAACAAGCGG | | 1 | 4 | 43 SEQ ID NO. 2495 |
| (N20)NGG | 2 | 220022244 | + | TGCAGCTTTCCTCGTCATTTGG | | 1 | 5 | 67 SEQ ID NO. 2496 |
| (N20)NGG | 2 | 220022271 | + | TCTCCTTCGCCCATTGTTGAAGG | | 3 | 13 | 95 SEQ ID NO. 2497 |
| (N20)NGG | 2 | 220022316 | + | TACCTTCCTGTGATTGTGTGG | | 4 | 70 | 594 SEQ ID NO. 2498 |
| (N20)NGG | 2 | 220022336 | + | TGGCAGATGCACTGATTCTACGG | | 1 | 3 | 32 SEQ ID NO. 2499 |
| (N20)NGG | 2 | 220022337 | + | GGCAGATGCACTGATTCTACGGG | | 1 | 2 | 19 SEQ ID NO. 2500 |
| (N20)NGG | 2 | 220022356 | + | CGGGTGCGAAGTGAGCTCTCGG | | 1 | 2 | 6 SEQ ID NO. 2501 |
| (N20)NGG | 2 | 220022372 | + | TCTCTGGCCTCCCCTTCTATTGG | | 1 | 6 | 82 SEQ ID NO. 2502 |
| (N20)NGG | 2 | 220022406 | + | CATGCTAGCTAGTCCTTCCCTGG | | 1 | 2 | 15 SEQ ID NO. 2503 |
| (N20)NGG | 2 | 220022426 | + | TGGTAAGTGTAATTCGAATGTGG | | 1 | 2 | 12 SEQ ID NO. 2504 |
| (N20)NGG | 2 | 220022427 | + | GGTAAGTGTAATTCGAATGTGGG | | 1 | 3 | 19 SEQ ID NO. 2505 |
| (N20)NGG | 2 | 220022428 | + | GTAAGTGTAATTCGAATGTGGGG | | 2 | 2 | 19 SEQ ID NO. 2506 |
| (N20)NGG | 2 | 220022175 | - | AGCTCCTAAAGAGAGAGCAGTGG | | 2 | 4 | 69 SEQ ID NO. 2507 |
| (N20)NGG | 2 | 220022217 | - | TGACAGAGGAAAGCTGCAGAGG | | 2 | 11 | 120 SEQ ID NO. 2508 |
| (N20)NGG | 2 | 220022220 | - | AAATGACAGAGGAAAGCTGCAGG | | 4 | 9 | 110 SEQ ID NO. 2509 |
| (N20)NGG | 2 | 220022231 | - | GGAGATTATCCAAATGACAGAGG | | 1 | 4 | 45 SEQ ID NO. 2510 |
| (N20)NGG | 2 | 220022252 | - | CGTCCTTCAACAATGGGCGAAGG | | 1 | 1 | 4 SEQ ID NO. 2511 |
| (N20)NGG | 2 | 220022258 | - | GAGCAGCGTCCTTCAACAATGGG | | 1 | 1 | 13 SEQ ID NO. 2512 |

FIG. 10 cont.

| site_type | site_chr omosome | site_start_ nucleotide | site_s trand | target_site_sequence_with_NGG | genome_wide_ hits_with_1_ or_less_mism atches | genome_wide_ hits_with_2_ or_less_mism atches | genome_wide_ hits_with_3_ or_less_mism atches | |
|---|---|---|---|---|---|---|---|---|
| (N20)NGG | 2 | 220022259 | - | TGAGCAGCGTCCTTCAACAATGG | 1 | 2 | 9 | SEQ ID NO. 2513 |
| (N20)NGG | 2 | 220022282 | - | AGGAGAAGGTAGCTTCGCTAGGG | 1 | 1 | 10 | SEQ ID NO. 2514 |
| (N20)NGG | 2 | 220022283 | - | CAGGAGAAGGTAGCTTCGCTAGG | 1 | 2 | 18 | SEQ ID NO. 2515 |
| (N20)NGG | 2 | 220022296 | - | TGCCACACAATCACAGAGAAGG | 1 | 6 | 119 | SEQ ID NO. 2516 |
| (N20)NGG | 2 | 220022302 | - | TGCATCTGCCACACAATCACAGG | 1 | 3 | 26 | SEQ ID NO. 2517 |
| (N20)NGG | 2 | 220022357 | - | GGAAAATTCCAATAGAAGGGGAGG | 1 | 3 | 48 | SEQ ID NO. 2518 |
| (N20)NGG | 2 | 220022360 | - | AGTGGAAATTCCAATAGAAGGGG | 2 | 4 | 68 | SEQ ID NO. 2519 |
| (N20)NGG | 2 | 220022361 | - | CAGTGGAAATTCCAATAGAAGGG | 1 | 4 | 79 | SEQ ID NO. 2520 |
| (N20)NGG | 2 | 220022362 | - | GCAGTGGAAATTCCAATAGAAGG | 1 | 3 | 33 | SEQ ID NO. 2521 |
| (N20)NGG | 2 | 220022378 | - | AAGGACTAGCTAGCATGCAGTGG | 1 | 1 | 20 | SEQ ID NO. 2522 |
| (N20)NGG | 2 | 220022397 | - | CGAATTACACTTACCAGGGAAGG | 1 | 1 | 14 | SEQ ID NO. 2523 |
| (N20)NGG | 2 | 220022401 | - | CATTCGAATTACACTTACCAGGG | 1 | 2 | 21 | SEQ ID NO. 2524 |
| (N20)NGG | 2 | 220022402 | - | ACATTCGAATTACACTTACCAGG | 1 | 3 | 14 | SEQ ID NO. 2525 |
| (N20)NGG | 2 | 220022910 | + | AATGAGACTTTTTGCAGATGG | 1 | 5 | 99 | SEQ ID NO. 2526 |
| (N20)NGG | 2 | 220022919 | + | TTTTTGCAGATGGAAGAACTGG | 1 | 7 | 146 | SEQ ID NO. 2527 |
| (N20)NGG | 2 | 220022926 | + | CAGATGAAGAACTGGAGCAAGG | 2 | 19 | 216 | SEQ ID NO. 2528 |
| (N20)NGG | 2 | 220022945 | + | AAGGCCTGTTGATGCAGCCATGG | 1 | 5 | 40 | SEQ ID NO. 2529 |
| (N20)NGG | 2 | 220022946 | + | AGGCCTGTTGATGCAGCCATGGG | 1 | 1 | 29 | SEQ ID NO. 2530 |
| (N20)NGG | 2 | 220022951 | + | TGTTGATGCAGCCATGGGCGTGG | 1 | 2 | 17 | SEQ ID NO. 2531 |
| (N20)NGG | 2 | 220022979 | + | GCTTGCAGAGAACTCCCTCTTGG | 1 | 3 | 30 | SEQ ID NO. 2532 |
| (N20)NGG | 2 | 220022985 | + | AGAGAACTCCCTCTTGGCCAAGG | 1 | 10 | 95 | SEQ ID NO. 2533 |
| (N20)NGG | 2 | 220023003 | + | CAAGGTTTTTATCACCAAGCAGG | 1 | 1 | 20 | SEQ ID NO. 2534 |
| (N20)NGG | 2 | 220023004 | + | AAGGTTTTTATCACCAAGCAGGG | 1 | 3 | 55 | SEQ ID NO. 2535 |
| (N20)NGG | 2 | 220023018 | + | CAAGCAGGGCTATGCCTTGTTGG | 1 | 1 | 25 | SEQ ID NO. 2536 |
| (N20)NGG | 2 | 220023036 | + | GTTGGTTTCAGATCTTCAACAGG | 1 | 1 | 28 | SEQ ID NO. 2537 |
| (N20)NGG | 2 | 220023041 | + | TTTCAGATCTTCAACAGGTGTGG | 1 | 2 | 31 | SEQ ID NO. 2538 |
| (N20)NGG | 2 | 220023051 | + | TCAACAGGTGTGCATGAACAGG | 1 | 2 | 38 | SEQ ID NO. 2539 |
| (N20)NGG | 2 | 220023054 | + | ACAGGTGTGCATGAACACAGGTGG | 1 | 3 | 58 | SEQ ID NO. 2540 |
| (N20)NGG | 2 | 220023066 | + | TGAACAGGTGGACACTAGTGTGG | 1 | 1 | 19 | SEQ ID NO. 2541 |
| (N20)NGG | 2 | 220023084 | + | TGTGGTCAGCCAGCCAGCCAAGG | 1 | 4 | 39 | SEQ ID NO. 2542 |
| (N20)NGG | 2 | 220023095 | + | AGCGAGCCAAGGTAAGTATGAGG | 1 | 1 | 14 | SEQ ID NO. 2543 |
| (N20)NGG | 2 | 220022927 | - | ACGCCCATGGCTGCATCAACAGG | 1 | 1 | 14 | SEQ ID NO. 2544 |
| (N20)NGG | 2 | 220022940 | - | GCAAGCTGTAGCCACGCCCATGG | 1 | 1 | 17 | SEQ ID NO. 2545 |
| (N20)NGG | 2 | 220022971 | - | GATAAAAACCTTGGCCAAGAGGG | 1 | 2 | 40 | SEQ ID NO. 2546 |

FIG. 10 cont.

| site_type | site_chr omosome | site_start_ nucleotide | site_s trand | target_site_sequence_with NGG | genome_wide_ hits_with_1_ or_less_mism atches | genome_wide_ hits_with_2_ or_less_mism atches | genome_wide_ hits_with_3_ or_less_mism atches | |
|---|---|---|---|---|---|---|---|---|
| (N20)NGG | 2 | 220022972 | - | TGATAAAAACCTTGGCCAAGAGG | 1 | 2 | 40 | SEQ ID NO. 2547 |
| (N20)NGG | 2 | 220022980 | - | CTGCTTGGTGATAAAAACCTTGG | 1 | 1 | 33 | SEQ ID NO. 2548 |
| (N20)NGG | 2 | 220022995 | - | CAACAAGGCATAGCCCTGCTTGG | 1 | 2 | 27 | SEQ ID NO. 2549 |
| (N20)NGG | 2 | 220023010 | - | TTGAAGATCTGAAACCAACAAGG | 1 | 3 | 66 | SEQ ID NO. 2550 |
| (N20)NGG | 2 | 220023071 | - | TCATACTTACCTTGGCTCGCTGG | 1 | 1 | 6 | SEQ ID NO. 2551 |
| (N20)NGG | 2 | 220023079 | - | ACTTCTCCTCATACTTACCTTGG | 1 | 2 | 35 | SEQ ID NO. 2552 |

FIG. 10 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 14 | 20937686 | + | AGAAGGCGTCTGCGAGACCATGG | 1 | 1 | 13 | SEQ ID NO. | 2553 |
| (N20)NGG | 14 | 20937693 | + | GTCTGCGAGACCATGGAGAACGG | 1 | 2 | 21 | SEQ ID NO. | 2554 |
| (N20)NGG | 14 | 20937694 | + | TCTGCGAGACCATGGAGAACGGG | 1 | 2 | 25 | SEQ ID NO. | 2555 |
| (N20)NGG | 14 | 20937699 | + | GAGACCATGGAGAACGGGTGAGG | 1 | 3 | 40 | SEQ ID NO. | 2556 |
| (N20)NGG | 14 | 20937702 | + | ACCATGGAGAACGGGTGAGGAGG | 1 | 3 | 41 | SEQ ID NO. | 2557 |
| (N20)NGG | 14 | 20937703 | + | CCATGGAGAACGGGTGAGGAGGG | 1 | 2 | 47 | SEQ ID NO. | 2558 |
| (N20)NGG | 14 | 20937710 | + | GAACGGGTGAGGAGGGCACCAGG | 1 | 4 | 36 | SEQ ID NO. | 2559 |
| (N20)NGG | 14 | 20937718 | + | GAGGAGGGCACCAGGCCCGCAGG | 1 | 5 | 57 | SEQ ID NO. | 2560 |
| (N20)NGG | 14 | 20937681 | - | CCCTCCTCACCCGTTCTCCATGG | 1 | 4 | 50 | SEQ ID NO. | 2561 |
| (N20)NGG | 14 | 20940502 | + | ATTATAAGAACACTGCAGAATGG | 2 | 12 | 138 | SEQ ID NO. | 2562 |
| (N20)NGG | 14 | 20940549 | + | CCTCAAGTTGCAATAATCTGTGG | 1 | 1 | 37 | SEQ ID NO. | 2563 |
| (N20)NGG | 14 | 20940555 | + | GTTGCAATAATCTGTGGTTCTGG | 1 | 5 | 26 | SEQ ID NO. | 2564 |
| (N20)NGG | 14 | 20940561 | + | ATAATCTGTGGTTCTGGATTAGG | 1 | 2 | 54 | SEQ ID NO. | 2565 |
| (N20)NGG | 14 | 20940564 | + | ATCTGTGGTTCTGGATTAGGAGG | 1 | 5 | 39 | SEQ ID NO. | 2566 |
| (N20)NGG | 14 | 20940587 | + | TCTGACTGATAAATTAACTCAGG | 2 | 3 | 41 | SEQ ID NO. | 2567 |
| (N20)NGG | 14 | 20940606 | + | CAGGCCCAGATCTTTGACTACGG | 1 | 2 | 42 | SEQ ID NO. | 2568 |
| (N20)NGG | 14 | 20940636 | + | CCCAACTTTCCCGAAGTACAGG | 1 | 1 | 17 | SEQ ID NO. | 2569 |
| (N20)NGG | 14 | 20940642 | + | TTTCCCCGAAGTACAGTACTGG | 1 | 2 | 31 | SEQ ID NO. | 2570 |
| (N20)NGG | 14 | 20940647 | + | CCGAAGTACAGGTACTGGCAAGG | 1 | 2 | 14 | SEQ ID NO. | 2571 |
| (N20)NGG | 14 | 20940648 | + | CGAAGTACAGGTACTGGCAAGGG | 1 | 1 | 15 | SEQ ID NO. | 2572 |
| (N20)NGG | 14 | 20940655 | + | CAGGTACTGGCAAGGGAAAGTGG | 1 | 2 | 87 | SEQ ID NO. | 2573 |
| (N20)NGG | 14 | 20940656 | + | AGGTACTGGCAAGGGAAAGTGGG | 1 | 4 | 61 | SEQ ID NO. | 2574 |
| (N20)NGG | 14 | 20940657 | + | GGTACTGGCAAGGGAAAGTGGG | 1 | 5 | 69 | SEQ ID NO. | 2575 |
| (N20)NGG | 14 | 20940443 | - | CTGGGGGAGAGAAAAATATCAAGG | 1 | 10 | 154 | SEQ ID NO. | 2576 |
| (N20)NGG | 14 | 20940459 | - | ATCTTTCATAGGTGTATCTGGGGG | 1 | 1 | 33 | SEQ ID NO. | 2577 |
| (N20)NGG | 14 | 20940460 | - | AATCTTCATAGGTGTATCTGGGG | 1 | 2 | 39 | SEQ ID NO. | 2578 |
| (N20)NGG | 14 | 20940461 | - | TAATCTTCATAGGTGTATCTGGG | 1 | 6 | 47 | SEQ ID NO. | 2579 |
| (N20)NGG | 14 | 20940462 | - | ATAATCTTCATAGGTGTATCTGG | 1 | 3 | 36 | SEQ ID NO. | 2580 |
| (N20)NGG | 14 | 20940471 | - | AGTGTTCTTATAATCTTCATAGG | 1 | 1 | 75 | SEQ ID NO. | 2581 |
| (N20)NGG | 14 | 20940523 | - | AGATTATTGCAACTTGAGGTCGG | 1 | 7 | 57 | SEQ ID NO. | 2582 |
| (N20)NGG | 14 | 20940527 | - | CCACAGATTATTGCAACTTGAGG | 1 | 7 | 61 | SEQ ID NO. | 2583 |
| (N20)NGG | 14 | 20940588 | - | TTTCACCGTAGTCAAAGATCTGG | 1 | 1 | 11 | SEQ ID NO. | 2584 |
| (N20)NGG | 14 | 20940589 | - | TTTCACCGTAGTCAAAGATCTGG | 1 | 1 | 20 | SEQ ID NO. | 2585 |
| (N20)NGG | 14 | 20940613 | - | CTGTACTTCGGGGAAAGTTGGGG | 1 | 1 | 14 | SEQ ID NO. | 2586 |

FIG. 11

| site_type | site_chr omosome | site_start_ nucleotide | site_s trand | target_site_sequence_with_ NGG | genome_wide_ hits_with_1 or_less_mism atches | genome_wide_ hits_with_2 or less_mismatc hes | genome_wide_h its_with_3 or_less_mism atches | |
|---|---|---|---|---|---|---|---|---|
| (N20)NGG | 14 | 20940614 | - | CCTGTACTTCGGGAAAGTTGGG | | 1 | 1 | 12 SEQ ID NO. 2587 |
| (N20)NGG | 14 | 20940615 | - | ACCTGTACTTCGGGGAAAGTTGG | | 1 | 1 | 10 SEQ ID NO. 2588 |
| (N20)NGG | 14 | 20940623 | - | TTGCCAGTACCTGTACTTCGGGG | | 1 | 2 | 13 SEQ ID NO. 2589 |
| (N20)NGG | 14 | 20940624 | - | CTTGCCAGTACCTGTACTTCGGG | | 1 | 2 | 22 SEQ ID NO. 2590 |
| (N20)NGG | 14 | 20940625 | - | CCTTGCCAGTACCTGTACTTCCG | | 1 | 4 | 33 SEQ ID NO. 2591 |
| (N20)NGG | 14 | 20942636 | + | TCTGTTTTGTATACAGTGCCAGG | | 1 | 3 | 59 SEQ ID NO. 2592 |
| (N20)NGG | 14 | 20942645 | + | TATACAGTGCCAGTCATGCTCG | | 1 | 1 | 17 SEQ ID NO. 2593 |
| (N20)NGG | 14 | 20942653 | + | GCCAGTCATGCTGGCCGACTGG | | 1 | 1 | 7 SEQ ID NO. 2594 |
| (N20)NGG | 14 | 20942660 | + | CATGCTGGCCGACTGGTGTTTGG | | 1 | 2 | 16 SEQ ID NO. 2595 |
| (N20)NGG | 14 | 20942661 | + | ATGCTGCCGACTGGTGTTTTGGG | | 1 | 3 | 16 SEQ ID NO. 2596 |
| (N20)NGG | 14 | 20942672 | + | CTGGTGTTTGGGTTCCTGAATGG | | 2 | 4 | 41 SEQ ID NO. 2597 |
| (N20)NGG | 14 | 20942676 | + | TGTTTGGGTTCCTGAATGGCAGG | | 1 | 9 | 44 SEQ ID NO. 2598 |
| (N20)NGG | 14 | 20942677 | + | GTTTGGGTTCCTGAATGGCAGGG | | 2 | 2 | 43 SEQ ID NO. 2599 |
| (N20)NGG | 14 | 20942695 | + | CAGGGCCTGTCCTGTGATGATGCAGG | | 1 | 2 | 66 SEQ ID NO. 2600 |
| (N20)NGG | 14 | 20942696 | + | AGGGCCTGTCCTGTGATGATGCAGGG | | 1 | 3 | 46 SEQ ID NO. 2601 |
| (N20)NGG | 14 | 20942700 | + | CCTGTGTGATGATGCAGGGCAGG | | 1 | 3 | 43 SEQ ID NO. 2602 |
| (N20)NGG | 14 | 20942717 | + | GGCAGGTTCCACATGTATGAAGG | | 1 | 1 | 23 SEQ ID NO. 2603 |
| (N20)NGG | 14 | 20942718 | + | GCAGGTTCCACATGTATGAAGGG | | 1 | 2 | 38 SEQ ID NO. 2604 |
| (N20)NGG | 14 | 20942730 | + | TGTATGAAGGGTACCCACTCTGG | | 1 | 1 | 14 SEQ ID NO. 2605 |
| (N20)NGG | 14 | 20942734 | + | TGAAGGGTACCCACTCTGGAAGG | | 1 | 2 | 24 SEQ ID NO. 2606 |
| (N20)NGG | 14 | 20942745 | + | CACTCTGGAAGGTAAGTCAGAGG | | 2 | 7 | 158 SEQ ID NO. 2607 |
| (N20)NGG | 14 | 20942746 | + | ACTCTGGAAGGTAAGTCAGAGGG | | 1 | 8 | 112 SEQ ID NO. 2608 |
| (N20)NGG | 14 | 20942751 | + | GGAAGGTAAGTCAGAGGGATAGG | | 1 | 4 | 63 SEQ ID NO. 2609 |
| (N20)NGG | 14 | 20942756 | + | GTAAGTCAGAGGGATAGGTCCGG | | 2 | 2 | 29 SEQ ID NO. 2610 |
| (N20)NGG | 14 | 20942632 | - | ACCAGTCGGCCAGCATGACCTGG | | 1 | 1 | 8 SEQ ID NO. 2611 |
| (N20)NGG | 14 | 20942646 | - | ACCAGAACCCAAAACACCAGTCGG | | 2 | 2 | 31 SEQ ID NO. 2612 |
| (N20)NGG | 14 | 20942664 | - | TCACACAGGCCCTGCCATTCAGG | | 1 | 4 | 46 SEQ ID NO. 2613 |
| (N20)NGG | 14 | 20942678 | - | CCTGCCCTGCATCATCACACAGG | | 1 | 5 | 47 SEQ ID NO. 2614 |
| (N20)NGG | 14 | 20942703 | - | GTGGCTACCCTTCATACATGTGG | | 1 | 1 | 12 SEQ ID NO. 2615 |
| (N20)NGG | 14 | 20942721 | - | TCTGACTTACCTTCCAGAGTGG | | 1 | 5 | 48 SEQ ID NO. 2616 |
| (N20)NGG | 14 | 20942722 | - | CTCTGACTTACCTTCCAGAGTGG | | 1 | 6 | 92 SEQ ID NO. 2617 |
| (N20)NGG | 14 | 20942931 | + | TTTTCGGATTGTTTGCTTCGAAGG | | 2 | 2 | 17 SEQ ID NO. 2618 |
| (N20)NGG | 14 | 20942948 | + | CGAAGGTGACATTCCCAGTGAGG | | 1 | 1 | 23 SEQ ID NO. 2619 |
| (N20)NGG | 14 | 20942949 | + | GAAGGTGACATTCCCAGTGAGGG | | 1 | 6 | 55 SEQ ID NO. 2620 |

FIG. 11 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 14 | 20942964 | + | AGTGAGGGTTTTCCACCTTCTGG | 3 | | 7 | 40 SEQ ID NO. 2621 |
| (N20)NGG | 14 | 20942965 | + | GTGAGGGTTTTCCACCTTCTGGG | 1 | | 3 | 32 SEQ ID NO. 2622 |
| (N20)NGG | 14 | 20942970 | + | GGTTTTCCACCTTCTGGGTGTGG | 2 | | 3 | 33 SEQ ID NO. 2623 |
| (N20)NGG | 14 | 20942979 | + | CCTTCTGGGTGTGGACACCCTGG | 1 | | 8 | 59 SEQ ID NO. 2624 |
| (N20)NGG | 14 | 20942998 | + | CTGGTAGTCACCAATGCAGCAGG | 1 | | 1 | 21 SEQ ID NO. 2625 |
| (N20)NGG | 14 | 20943001 | + | GTAGTCACCAATGCAGCAGGAGG | 1 | | 1 | 22 SEQ ID NO. 2626 |
| (N20)NGG | 14 | 20943002 | + | TAGTCACCAATGCAGCAGGAGGG | 1 | | 1 | 35 SEQ ID NO. 2627 |
| (N20)NGG | 14 | 20943021 | + | AGGGCTGAACCCAAGTTTGAGG | 1 | | 6 | 51 SEQ ID NO. 2628 |
| (N20)NGG | 14 | 20943025 | + | CTGAACCCAAGTTTGAGGTTGG | 1 | | 7 | 48 SEQ ID NO. 2629 |
| (N20)NGG | 14 | 20943064 | + | CGTGACCATATCAACCTACCTGG | 1 | | 1 | 11 SEQ ID NO. 2630 |
| (N20)NGG | 14 | 20943073 | + | ATCAACCTACCTGGTTTCAGTGG | 1 | | 4 | 25 SEQ ID NO. 2631 |
| (N20)NGG | 14 | 20943091 | + | AGTGGTCAGAACCCTCTCAGAGG | 1 | | 2 | 29 SEQ ID NO. 2632 |
| (N20)NGG | 14 | 20943092 | + | GTGGTCAGAACCCTCTCAGAGGG | 1 | | 2 | 48 SEQ ID NO. 2633 |
| (N20)NGG | 14 | 20943107 | + | TCAGAGGGCCAATGATGAAAGG | 1 | | 3 | 26 SEQ ID NO. 2634 |
| (N20)NGG | 14 | 20942939 | - | GAAGGTGGAAAACCCTCACTGG | 3 | | 6 | 47 SEQ ID NO. 2635 |
| (N20)NGG | 14 | 20942940 | - | AGAAGGTGGAAAACCCTCACTGG | 1 | | 3 | 41 SEQ ID NO. 2636 |
| (N20)NGG | 14 | 20942954 | - | GGGGTGTCCACACCCAGAAGGTGG | 1 | | 3 | 75 SEQ ID NO. 2637 |
| (N20)NGG | 14 | 20942957 | - | CCAGGGTGTCCACACCCAGAAGG | 2 | | 4 | 66 SEQ ID NO. 2638 |
| (N20)NGG | 14 | 20942974 | - | TGCTTGCATTGGTGACTACCAGG | 1 | | 4 | 24 SEQ ID NO. 2639 |
| (N20)NGG | 14 | 20942975 | - | CTGCTGCATTGGTGACTACCAGG | 1 | | 3 | 23 SEQ ID NO. 2640 |
| (N20)NGG | 14 | 20942986 | - | GTTCAGCCCCTCCTGCTGCATTGG | 1 | | 6 | 37 SEQ ID NO. 2641 |
| (N20)NGG | 14 | 20943008 | - | TATCTCCAACCTCAAACTTGGG | 1 | | 2 | 45 SEQ ID NO. 2642 |
| (N20)NGG | 14 | 20943009 | - | ATATCTCCAACCTCAAACTTGGG | 1 | | 2 | 35 SEQ ID NO. 2643 |
| (N20)NGG | 14 | 20943010 | - | GATATCTCCAACCTCAAACTTGG | 1 | | 1 | 33 SEQ ID NO. 2644 |
| (N20)NGG | 14 | 20943041 | - | CAGGTAGGTTGATATGGTCACGG | 1 | | 3 | 24 SEQ ID NO. 2645 |
| (N20)NGG | 14 | 20943047 | - | TGAAACCAGGTAGGTTGATATGG | 1 | | 3 | 25 SEQ ID NO. 2646 |
| (N20)NGG | 14 | 20943056 | - | TCTGACCAAACCAGGTAGG | 1 | | 6 | 45 SEQ ID NO. 2647 |
| (N20)NGG | 14 | 20943060 | - | GGGTTCTGACCACTGAAACCAGG | 1 | | 2 | 20 SEQ ID NO. 2648 |
| (N20)NGG | 14 | 20943080 | - | CATCATTGGGCCCTCTGAGAGGG | 1 | | 2 | 20 SEQ ID NO. 2649 |
| (N20)NGG | 14 | 20943081 | - | TCATCATTGGGCCCTCTGAGAGG | 1 | | 1 | 27 SEQ ID NO. 2650 |
| (N20)NGG | 14 | 20943093 | - | CATACATACCTTTCATCATTGG | 1 | | 3 | 50 SEQ ID NO. 2651 |
| (N20)NGG | 14 | 20943094 | - | ACATACATACCTTTCATCATTGG | 1 | | 4 | 52 SEQ ID NO. 2652 |
| (N20)NGG | 14 | 20943220 | + | GATAATTCAACCTGTGTCCTAGG | 1 | | 2 | 32 SEQ ID NO. 2653 |
| (N20)NGG | 14 | 20943225 | + | TTCAACCTGTGTCCTAGGTTTGG | 1 | | 3 | 40 SEQ ID NO. 2654 |

| site type | site_chr omosome | site_start_ nucleotide | site_s trand | target_site_sequence_with_ NGG | genome_wide_ hits_with_1_ or_less_mism atches | genome_wide_ hits_with_2_or_ less_mismatc hes | genome_wide_h its_with_3_ or_less_mism atches | | |
|---|---|---|---|---|---|---|---|---|---|
| (N20)NGG | 14 | 20943262 | + | CCATGTCTGATGCCTACGACCGG | 1 | | 2 | 10 | SEQ ID NO. 2655 |
| (N20)NGG | 14 | 20943271 | + | ATGCCTACGACCGGACTATGAGG | 1 | | 1 | 3 | SEQ ID NO. 2656 |
| (N20)NGG | 14 | 20943277 | + | ACGACCGGACTATGAGGCAGAGG | 1 | | 1 | 9 | SEQ ID NO. 2657 |
| (N20)NGG | 14 | 20943278 | + | CGACCGGACTATGAGGCAGAGGG | 1 | | 1 | 9 | SEQ ID NO. 2658 |
| (N20)NGG | 14 | 20943292 | + | GGCAGAGGGCTCTCAGTACCTGG | 1 | | 4 | 36 | SEQ ID NO. 2659 |
| (N20)NGG | 14 | 20943302 | + | TCTCAGTACCTGGAAACAAATGG | 1 | | 5 | 70 | SEQ ID NO. 2660 |
| (N20)NGG | 14 | 20943303 | + | CTCAGTACCTGGAAACAAATGGG | 1 | | 2 | 54 | SEQ ID NO. 2661 |
| (N20)NGG | 14 | 20943304 | + | TCAGTACCTGGAAACAAATGGGG | 1 | | 5 | 60 | SEQ ID NO. 2662 |
| (N20)NGG | 14 | 20943305 | + | CAGTACCTGGAAACAAATGGGGG | 1 | | 8 | 49 | SEQ ID NO. 2663 |
| (N20)NGG | 14 | 20943323 | + | GGGGGAGCAACGTGAGCTACAGG | 1 | | 1 | 5 | SEQ ID NO. 2664 |
| (N20)NGG | 14 | 20943327 | + | GGAGCAACGTGAGCTACAGGAAGG | 1 | | 3 | 20 | SEQ ID NO. 2665 |
| (N20)NGG | 14 | 20943341 | + | ACAGGAAGGCACCTATGTGATGG | 2 | | 5 | 29 | SEQ ID NO. 2666 |
| (N20)NGG | 14 | 20943344 | + | GGAAGGCACCTATGTGATGGTGG | 1 | | 4 | 41 | SEQ ID NO. 2667 |
| (N20)NGG | 14 | 20943348 | + | GGCACCTATGTGATGGTCGCAGG | 1 | | 1 | 26 | SEQ ID NO. 2668 |
| (N20)NGG | 14 | 20943368 | + | AGGCCCCAGCTTTGAGACTGTGG | 1 | | 7 | 96 | SEQ ID NO. 2669 |
| (N20)NGG | 14 | 20943395 | + | ATGTCGTGTCTGCAGAAGCTGTG | 1 | | 7 | 37 | SEQ ID NO. 2670 |
| (N20)NGG | 14 | 20943396 | + | TGTCGTGTCTGCAGAAGCTGTTGG | 1 | | 2 | 25 | SEQ ID NO. 2671 |
| (N20)NGG | 14 | 20943411 | + | AAGCTGGGAGCAGACGCTGTTGG | 1 | | 4 | 38 | SEQ ID NO. 2672 |
| (N20)NGG | 14 | 20943419 | + | AGCAGACGCTGTTGGTGAGAAGG | 1 | | 2 | 35 | SEQ ID NO. 2673 |
| (N20)NGG | 14 | 20943420 | + | GCAGACGCTGTTGGTGAGAAGGG | 1 | | 3 | 37 | SEQ ID NO. 2674 |
| (N20)NGG | 14 | 20943421 | + | CAGACGCTGTTGGTGAGAAGGGG | 1 | | 2 | 39 | SEQ ID NO. 2675 |
| (N20)NGG | 14 | 20943428 | + | TGTTGGTGAGAAGGGGAATTTGG | 1 | | 2 | 109 | SEQ ID NO. 2676 |
| (N20)NGG | 14 | 20943432 | + | GGTGAGAAGGGGAATTTGGCTGG | 1 | | 9 | 57 | SEQ ID NO. 2677 |
| (N20)NGG | 14 | 20943208 | - | GATCTCCAAACCTAGGACACAGG | 1 | | 5 | 22 | SEQ ID NO. 2678 |
| (N20)NGG | 14 | 20943215 | - | GGGAAACGATCTCCAAACCTAGG | 1 | | 1 | 10 | SEQ ID NO. 2679 |
| (N20)NGG | 14 | 20943235 | - | CGTAGGCATCAGACATGGCAGG | 1 | | 1 | 17 | SEQ ID NO. 2680 |
| (N20)NGG | 14 | 20943236 | - | TCGTAGGCATCAGACATGGCAGG | 1 | | 2 | 17 | SEQ ID NO. 2681 |
| (N20)NGG | 14 | 20943240 | - | CCGGTCGTAGGCATCAGACATGG | 1 | | 1 | 4 | SEQ ID NO. 2682 |
| (N20)NGG | 14 | 20943252 | - | CTGCCTCATAGTCCGGTCGTAGG | 1 | | 1 | 6 | SEQ ID NO. 2683 |
| (N20)NGG | 14 | 20943259 | - | GAGCCTCTGCCTCATAGTCCGG | 1 | | 3 | 26 | SEQ ID NO. 2684 |
| (N20)NGG | 14 | 20943288 | - | TTGCTCCCCATTTGTTTCCAGG | 1 | | 5 | 49 | SEQ ID NO. 2685 |
| (N20)NGG | 14 | 20943330 | - | GGGGCCTGCCACCATCACATAGG | 1 | | 2 | 43 | SEQ ID NO. 2686 |
| (N20)NGG | 14 | 20943349 | - | CTGCCACAGTCTCAAAGCTGGGG | 1 | | 3 | 74 | SEQ ID NO. 2687 |
| (N20)NGG | 14 | 20943350 | - | TCTGCCACAGTCTCAAAGCTGGG | 1 | | 4 | 55 | SEQ ID NO. 2688 |

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 14 | 20943351 | - | TTCTGCCACAGTCTCAAAGCTGG | 1 | | 7 | 50 SEQ ID NO. 2689 |
| (N20)NGG | 14 | 20944542 | + | TTTCCATCTTTCTCACTATCAGG | 1 | | 13 | 112 SEQ ID NO. 2690 |
| (N20)NGG | 14 | 20944576 | + | TACCAGAAGTTATCGTTGCACGG | 1 | | 3 | 9 SEQ ID NO. 2691 |
| (N20)NGG | 14 | 20944584 | + | GTTATCGTTGCACGGCACTGTGG | 1 | | 1 | 10 SEQ ID NO. 2692 |
| (N20)NGG | 14 | 20944599 | + | CACTGTGGACTTCGAGTCTTTGG | 1 | | 2 | 23 SEQ ID NO. 2693 |
| (N20)NGG | 14 | 20944622 | + | CTTCTCACTCATCACTAACAAGG | 2 | | 3 | 48 SEQ ID NO. 2694 |
| (N20)NGG | 14 | 20944631 | + | CATCACTAACAAGGTCATCATGG | 2 | | 6 | 50 SEQ ID NO. 2695 |
| (N20)NGG | 14 | 20944646 | + | CATCATGGATTATGAAAAGCCTGG | 3 | | 10 | 43 SEQ ID NO. 2696 |
| (N20)NGG | 14 | 20944652 | + | GGATTATGAAAGCCTGGAGAAGG | 2 | | 4 | 62 SEQ ID NO. 2697 |
| (N20)NGG | 14 | 20944680 | + | CATGAAGAAGTCTTAGCAGCTGG | 2 | | 5 | 31 SEQ ID NO. 2698 |
| (N20)NGG | 14 | 20944703 | + | CAAACAAGCTGCACAGAAATTGG | 2 | | 5 | 57 SEQ ID NO. 2699 |
| (N20)NGG | 14 | 20944727 | + | ACAGTTTGTCTCCATTCTTATGG | 2 | | 5 | 60 SEQ ID NO. 2700 |
| (N20)NGG | 14 | 20944769 | + | CAAAGCCAGTTGACCTGCCTTGG | 1 | | 3 | 39 SEQ ID NO. 2701 |
| (N20)NGG | 14 | 20944779 | + | TGACCTGCCTTGGAGTCGTCTGG | 1 | | 1 | 14 SEQ ID NO. 2702 |
| (N20)NGG | 14 | 20944523 | - | ATGCCTGATAGTGAGAAAGATGG | 1 | | 5 | 60 SEQ ID NO. 2703 |
| (N20)NGG | 14 | 20944556 | - | TGCCGTGCAACGATAACTTCTGG | 1 | | 1 | 6 SEQ ID NO. 2704 |
| (N20)NGG | 14 | 20944642 | - | CTTCATGGTTGGCCTTCTCCAGG | 1 | | 1 | 32 SEQ ID NO. 2705 |
| (N20)NGG | 14 | 20944653 | - | TGCTAAGACTTCTTCATGGTTGG | 2 | | 4 | 30 SEQ ID NO. 2706 |
| (N20)NGG | 14 | 20944657 | - | CAGCTGCTAAGACTTCTTCATGG | 1 | | 5 | 56 SEQ ID NO. 2707 |
| (N20)NGG | 14 | 20944716 | - | TGGAATGCTGGCCATAAGAATGG | 1 | | 4 | 47 SEQ ID NO. 2708 |
| (N20)NGG | 14 | 20944728 | - | TTTGTCAGGAGTGGAATGCTGG | 1 | | 4 | 51 SEQ ID NO. 2709 |
| (N20)NGG | 14 | 20944736 | - | CAACTGGCTTTGTCAGGAGTGG | 1 | | 2 | 44 SEQ ID NO. 2710 |
| (N20)NGG | 14 | 20944741 | - | CAGGTCAACTGGCTTTGTCAGGG | 1 | | 4 | 36 SEQ ID NO. 2711 |
| (N20)NGG | 14 | 20944742 | - | GCAGGTCAACTGGCTTTGTCAG | 1 | | 1 | 22 SEQ ID NO. 2712 |
| (N20)NGG | 14 | 20944752 | - | CGACTCCAAGGCAGGTCAACTGG | 1 | | 1 | 13 SEQ ID NO. 2713 |
| (N20)NGG | 14 | 20944760 | - | ATGCCAGACGACTCCAAGGCAGG | 1 | | 1 | 10 SEQ ID NO. 2714 |

FIG. 11 cont.

| site type | site_chromosome | site_start_nucleotide | site_strand | target_site_sequence_with NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48686749 | + | TTCCAGTGATGAGTACTCCTGG | | 1 | 3 | 23 SEQ ID NO. 2715 |
| (N20)NGG | 8 | 48686750 | + | TCCAGTGATGAGTACTCCTGGG | | 1 | 2 | 19 SEQ ID NO. 2716 |
| (N20)NGG | 8 | 48686761 | + | GCTACTCCTGGGTCATGAGAAGG | | 1 | 1 | 24 SEQ ID NO. 2717 |
| (N20)NGG | 8 | 48686785 | + | CCCTGCCTTCAGAGACTATGTGG | | 1 | 6 | 64 SEQ ID NO. 2718 |
| (N20)NGG | 8 | 48686791 | + | CTTCAGAGACTATGTGCTGTGG | | 1 | 3 | 39 SEQ ID NO. 2719 |
| (N20)NGG | 8 | 48686798 | + | GACTATGTGCTGTGGCACGAGG | | 1 | 2 | 27 SEQ ID NO. 2720 |
| (N20)NGG | 8 | 48686840 | + | CGTGCCCAAGAACCAGAGAGTGG | | 2 | 5 | 35 SEQ ID NO. 2721 |
| (N20)NGG | 8 | 48686841 | + | GTGCCCAAGAACCAGAGAGTGGG | | 2 | 4 | 44 SEQ ID NO. 2722 |
| (N20)NGG | 8 | 48686875 | + | GACTCAAGTGAAGTGCCTGATGG | | 1 | 2 | 29 SEQ ID NO. 2723 |
| (N20)NGG | 8 | 48686881 | + | AGTGAAGTGCCTGATGGACCAGG | | 1 | 3 | 51 SEQ ID NO. 2724 |
| (N20)NGG | 8 | 48686903 | + | GCAACAGACCCCAACATCCTTGG | | 1 | 7 | 44 SEQ ID NO. 2725 |
| (N20)NGG | 8 | 48686913 | + | CCAACATCCTTGGCAGAACCTGG | | 1 | 2 | 46 SEQ ID NO. 2726 |
| (N20)NGG | 8 | 48686914 | + | CAACATCCTTGGCAGAACCTGGG | | 1 | 4 | 41 SEQ ID NO. 2727 |
| (N20)NGG | 8 | 48686918 | + | ATCCTTGGCAGAACCTGGGAAGG | | 1 | 3 | 53 SEQ ID NO. 2728 |
| (N20)NGG | 8 | 48686922 | + | TTGGCAGAACCTGGGAAGGATGG | | 1 | 12 | 201 SEQ ID NO. 2729 |
| (N20)NGG | 8 | 48686923 | + | TGGCAGAACCTGGGAAGGATGGG | | 1 | 4 | 78 SEQ ID NO. 2730 |
| (N20)NGG | 8 | 48686931 | + | CCTGGGAAGGATGGGAGCCCTGG | | 2 | 13 | 133 SEQ ID NO. 2731 |
| (N20)NGG | 8 | 48686939 | + | GGATGGGAGCCCTGGATGTGAGG | | 1 | 9 | 87 SEQ ID NO. 2732 |
| (N20)NGG | 8 | 48686946 | + | AGCCCTGGATGTGAGGTCTGTGG | | 2 | 12 | 178 SEQ ID NO. 2733 |
| (N20)NGG | 8 | 48686947 | + | GCCCTGGATGTGAGGTCTGTGGG | | 1 | 5 | 45 SEQ ID NO. 2734 |
| (N20)NGG | 8 | 48686729 | - | ACCCAGGAGTAGCTCATCACTGG | | 1 | 1 | 23 SEQ ID NO. 2735 |
| (N20)NGG | 8 | 48686745 | - | CAGGGGCCTTCTCATGACCCAGG | | 1 | 5 | 41 SEQ ID NO. 2736 |
| (N20)NGG | 8 | 48686762 | - | CACATAGTCTCTGAAGGCAGGGG | | 1 | 1 | 97 SEQ ID NO. 2737 |
| (N20)NGG | 8 | 48686763 | - | CCACATAGTCTCTGAAGGCAGG | | 2 | 5 | 40 SEQ ID NO. 2738 |
| (N20)NGG | 8 | 48686764 | - | GCCACATAGTCTCTGAAGGCAG | | 1 | 2 | 28 SEQ ID NO. 2739 |
| (N20)NGG | 8 | 48686768 | - | CACAGCCACATAGTCTCTGAAGG | | 1 | 4 | 39 SEQ ID NO. 2740 |
| (N20)NGG | 8 | 48686822 | - | AAGCCCACTCTCTGGTTCTTGG | | 1 | 6 | 53 SEQ ID NO. 2741 |
| (N20)NGG | 8 | 48686823 | - | AAAGCCCACTCTCTGGTTCTTGG | | 2 | 6 | 91 SEQ ID NO. 2742 |
| (N20)NGG | 8 | 48686830 | - | TCTTCTGAAAGCCCACTCTCTGG | | 1 | 3 | 57 SEQ ID NO. 2743 |
| (N20)NGG | 8 | 48686868 | - | GGTCGTTGCCTGGTCATCAGG | | 1 | 1 | 14 SEQ ID NO. 2744 |
| (N20)NGG | 8 | 48686877 | - | GGATGTTGGGGTCGTTGCCTGG | | 1 | 1 | 28 SEQ ID NO. 2745 |
| (N20)NGG | 8 | 48686889 | - | AGGTTCTGCCAAGGATGTTGGGG | | 1 | 1 | 42 SEQ ID NO. 2746 |
| (N20)NGG | 8 | 48686890 | - | CAGGTTCTGCCAAGGATGTTGG | | 1 | 2 | 79 SEQ ID NO. 2747 |

FIG. 12

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48686891 | - | CCAGTTCTGCCAAGGATGTTGG | 2 | 8 | 62 | SEQ ID NO. 2748 |
| (N20)NGG | 8 | 48686898 | - | ATCCTTCCCAGTTCTGCCAAGG | 1 | 4 | 65 | SEQ ID NO. 2749 |
| (N20)NGG | 8 | 48686909 | - | CCAGGGCTCCCATCCTTCCCAGG | 2 | 11 | 112 | SEQ ID NO. 2750 |
| (N20)NGG | 8 | 48686926 | - | TCCCACAGACCTCACATCCAGG | 2 | 4 | 162 | SEQ ID NO. 2751 |
| (N20)NGG | 8 | 48686927 | - | CTCCACAGACCTCACATCCAGG | 1 | 11 | 200 | SEQ ID NO. 2752 |
| (N20)NGG | 8 | 48689432 | + | GAACAGAAAATGCTGAAAAAAGG | 1 | 14 | 354 | SEQ ID NO. 2753 |
| (N20)NGG | 8 | 48689435 | + | CAGAAAATGCTGAAAAAAGGAGG | 1 | 15 | 204 | SEQ ID NO. 2754 |
| (N20)NGG | 8 | 48689436 | + | AGAAAATGCTGAAAAAAGGAGGG | 3 | 26 | 403 | SEQ ID NO. 2755 |
| (N20)NGG | 8 | 48689442 | + | TGCTGAAAAAAGGAGGGTCATGG | 1 | 4 | 67 | SEQ ID NO. 2756 |
| (N20)NGG | 8 | 48689475 | + | TAAATGTTGCTGAAAAAAATTGG | 3 | 49 | 626 | SEQ ID NO. 2757 |
| (N20)NGG | 8 | 48689519 | + | TACGCTAAGAGAAAGTTAGCAGG | 1 | 2 | 14 | SEQ ID NO. 2758 |
| (N20)NGG | 8 | 48689544 | + | CCAATCCAGCAGTCATTACTTGG | 1 | 4 | 28 | SEQ ID NO. 2759 |
| (N20)NGG | 8 | 48689562 | + | CTTGGTAAGATTTTCTGTCGGTGG | 1 | 5 | 95 | SEQ ID NO. 2760 |
| (N20)NGG | 8 | 48689478 | - | CGTAACATATTTTCTGTCGGGGG | 1 | 1 | 7 | SEQ ID NO. 2761 |
| (N20)NGG | 8 | 48689479 | - | GCGTAACATATTTTCTGTCGGG | 1 | 3 | 16 | SEQ ID NO. 2762 |
| (N20)NGG | 8 | 48689480 | - | AGCGTAACATATTTTCTGTCGG | 2 | 12 | 185 | SEQ ID NO. 2763 |
| (N20)NGG | 8 | 48689481 | - | TAGCGTAACATATTTTCTGTCG | 1 | 2 | 40 | SEQ ID NO. 2764 |
| (N20)NGG | 8 | 48689522 | - | CCAAGTAATGACTGCTGATTGG | 1 | 3 | 25 | SEQ ID NO. 2765 |
| (N20)NGG | 8 | 48689527 | - | TCTTACCAAGTAATGACTGCTGG | 1 | 3 | 21 | SEQ ID NO. 2766 |
| (N20)NGG | 8 | 48690278 | + | TCCCTGAGTTGATGCCTTTTCGG | 2 | 5 | 57 | SEQ ID NO. 2767 |
| (N20)NGG | 8 | 48690324 | + | GATGTTACCAATGAAAGAAACGG | 2 | 10 | 154 | SEQ ID NO. 2768 |
| (N20)NGG | 8 | 48690325 | + | ATGTTACCAATGAAAGAAACGGG | 3 | 19 | 266 | SEQ ID NO. 2769 |
| (N20)NGG | 8 | 48690345 | + | GGGCCTTATGTACAGCATCATGG | 1 | 4 | 31 | SEQ ID NO. 2770 |
| (N20)NGG | 8 | 48690359 | + | GCATCATGGTACACGCACTCCGG | 1 | 1 | 8 | SEQ ID NO. 2771 |
| (N20)NGG | 8 | 48690360 | + | CATCATGGTACACGCACTCCGGG | 1 | 1 | 8 | SEQ ID NO. 2772 |
| (N20)NGG | 8 | 48690379 | + | CGGGCCTTCCGCTCAGACCCTGG | 1 | 1 | 22 | SEQ ID NO. 2773 |
| (N20)NGG | 8 | 48690399 | + | TGGCCTGCTCACCAACACCATGG | 1 | 2 | 38 | SEQ ID NO. 2774 |
| (N20)NGG | 8 | 48690414 | + | CACCATGGATGTGTTTGTCAAGG | 1 | 3 | 47 | SEQ ID NO. 2775 |
| (N20)NGG | 8 | 48690431 | + | TCAAGGAGCCCTCCTTTGATTGG | 1 | 3 | 47 | SEQ ID NO. 2776 |
| (N20)NGG | 8 | 48690439 | - | CCCTCCTTTGATTGGAAAGTAGG | 1 | 6 | 31 | SEQ ID NO. 2777 |
| (N20)NGG | 8 | 48690224 | - | ACTAAACAAGAAAAAAGGCAAGG | 1 | 20 | 401 | SEQ ID NO. 2778 |
| (N20)NGG | 8 | 48690229 | - | CAGAAACTAAACAAGAAAAAAGG | 2 | 47 | 851 | SEQ ID NO. 2779 |
| (N20)NGG | 8 | 48690252 | - | AAAGGCATCAACTCAGGGACTGG | 1 | 3 | 36 | SEQ ID NO. 2780 |

FIG. 12 cont.

| site_type | site_chromosome | site_start_nucleotide | site_strand | target_site_sequence_with NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48690257 | - | GCCGAAAAGGCATCAACTCAGGG | 1 | 1 | 12 | SEQ ID NO. 2781 |
| (N20)NGG | 8 | 48690258 | - | AGCCGAAAAGGCATCAACTCAGG | 1 | 2 | 15 | SEQ ID NO. 2782 |
| (N20)NGG | 8 | 48690270 | - | AACTGGCCAGTTAGCCGAAAAGG | 1 | 1 | 3 | SEQ ID NO. 2783 |
| (N20)NGG | 8 | 48690287 | - | GTAACATCAGATTGATAAACTGG | 1 | 7 | 35 | SEQ ID NO. 2784 |
| (N20)NGG | 8 | 48690309 | - | ATAAGGCCCGTTTCTTTCATTGG | 1 | 2 | 23 | SEQ ID NO. 2785 |
| (N20)NGG | 8 | 48690326 | - | GTACCATGATGCTGTACATAAGG | 1 | 2 | 25 | SEQ ID NO. 2786 |
| (N20)NGG | 8 | 48690356 | - | CAGGGTCTGAGCGGAAGGCCCGG | 1 | 3 | 35 | SEQ ID NO. 2787 |
| (N20)NGG | 8 | 48690361 | - | CAGGCCAGGTCTGAGCGGAAGG | 1 | 4 | 60 | SEQ ID NO. 2788 |
| (N20)NGG | 8 | 48690365 | - | TGAGCAGGCCAGGGTCTGAGCGG | 1 | 14 | 94 | SEQ ID NO. 2789 |
| (N20)NGG | 8 | 48690374 | - | TGGTGTTGGTGAGCAGGCCAGGG | 1 | 4 | 52 | SEQ ID NO. 2790 |
| (N20)NGG | 8 | 48690375 | - | ATGGTGTTGGTGAGCAGGCCAGG | 1 | 3 | 64 | SEQ ID NO. 2791 |
| (N20)NGG | 8 | 48690380 | - | CATCCATGGTGTTGGTGAGCAGG | 1 | 1 | 22 | SEQ ID NO. 2792 |
| (N20)NGG | 8 | 48690388 | - | GACAAACACATCCATGGTGTTGG | 1 | 2 | 42 | SEQ ID NO. 2793 |
| (N20)NGG | 8 | 48690394 | - | CTCCTTGACAAACACATCCATGG | 2 | 3 | 53 | SEQ ID NO. 2794 |
| (N20)NGG | 8 | 48690417 | - | CCTACTTTCCAATCAAAGGAGGG | 1 | 1 | 35 | SEQ ID NO. 2795 |
| (N20)NGG | 8 | 48690418 | - | ACCTACTTTCCAATCAAAGGAGG | 1 | 2 | 33 | SEQ ID NO. 2796 |
| (N20)NGG | 8 | 48690421 | - | AAAACTACTTTCCAATCAAAGG | 2 | 4 | 68 | SEQ ID NO. 2797 |
| (N20)NGG | 8 | 48691019 | + | CACAGCTGTGTCTCTTTTTGTAGG | 1 | 5 | 67 | SEQ ID NO. 2798 |
| (N20)NGG | 8 | 48691022 | + | AGCTGTGTCTCTTTTGTAGGCGG | 1 | 5 | 50 | SEQ ID NO. 2799 |
| (N20)NGG | 8 | 48691023 | + | GCTGTGTCTCTTTTGTAGGCGGG | 1 | 3 | 42 | SEQ ID NO. 2800 |
| (N20)NGG | 8 | 48691034 | + | TTTGTAGGCGGGCCTTCGTGAGG | 1 | 1 | 9 | SEQ ID NO. 2801 |
| (N20)NGG | 8 | 48691053 | + | GAGGATGAGTACAAGCCCTGAGG | 1 | 2 | 34 | SEQ ID NO. 2802 |
| (N20)NGG | 8 | 48691062 | + | TACAAGCCCTGAGGCTTTCCTGG | 2 | 5 | 39 | SEQ ID NO. 2803 |
| (N20)NGG | 8 | 48691115 | + | CTCTGATATGCATCAGCCACTGG | 1 | 1 | 28 | SEQ ID NO. 2804 |
| (N20)NGG | 8 | 48691123 | + | TGCATCAGCCACTGGATCCTCGG | 1 | 2 | 37 | SEQ ID NO. 2805 |
| (N20)NGG | 8 | 48691124 | + | GCATCAGCCACTGGATCCTCGGG | 1 | 2 | 36 | SEQ ID NO. 2806 |
| (N20)NGG | 8 | 48691129 | + | AGCCACTGGATCCTCGGGATTGG | 1 | 1 | 11 | SEQ ID NO. 2807 |
| (N20)NGG | 8 | 48691155 | + | CAGACATCTGAACAACTTTATGG | 2 | 3 | 37 | SEQ ID NO. 2808 |
| (N20)NGG | 8 | 48691158 | + | ACATCTGAACAACTTTATGTGG | 1 | 3 | 54 | SEQ ID NO. 2809 |
| (N20)NGG | 8 | 48691164 | + | GAACAACTTTATGGTGGCCATGG | 1 | 4 | 30 | SEQ ID NO. 2810 |
| (N20)NGG | 8 | 48691171 | + | TTTATGGTGGCCATGGAGACTGG | 1 | 5 | 49 | SEQ ID NO. 2811 |
| (N20)NGG | 8 | 48691174 | + | ATGGTGGCCATGGAGACTGCGG | 1 | 10 | 88 | SEQ ID NO. 2812 |
| (N20)NGG | 8 | 48691183 | + | ATGGAGACTGGCGGCGTGATCGG | | 2 | 7 | SEQ ID NO. 2813 |

FIG. 12 cont.

| site_type | site_chr omosome | site_start_ nucleotide | site_s trand | target_site_sequence_wi th NGG | genome_wide_ hits_with_1 or_less_mism atches | genome_wide_ hits_with_ 2_or_less_m ismatches | genome_wide_ hits_with_3 or_less_mism atches | |
|---|---|---|---|---|---|---|---|---|
| (N20)NGG | 8 | 48691184 | + | TGGAGACTGGCGCGTGATCGGG | | 1 | 16 | SEQ ID NO. 2814 |
| (N20)NGG | 8 | 48691195 | + | GGCGTGATCGGGATCGACTTTGG | | 1 | 3 | SEQ ID NO. 2815 |
| (N20)NGG | 8 | 48691196 | + | GCGTGATCGGGATCGACTTTGGG | | 1 | 1 | SEQ ID NO. 2816 |
| (N20)NGG | 8 | 48691207 | + | ATCGACTTTGGGCATGCGTTTGG | | 1 | 5 | SEQ ID NO. 2817 |
| (N20)NGG | 8 | 48691221 | + | TGCGTTTGGATCCGCTACACAGG | | 1 | 3 | SEQ ID NO. 2818 |
| (N20)NGG | 8 | 48690994 | - | ACAAAAGAGACACAGCTGTGCGG | | 1 | 106 | SEQ ID NO. 2819 |
| (N20)NGG | 8 | 48691024 | - | GCTTGTACTCATCCTCACGAAGG | | 7 | 8 | SEQ ID NO. 2820 |
| (N20)NGG | 8 | 48691046 | - | GGAGCGCCAGGAAAGCCTCAGGG | | 2 | 39 | SEQ ID NO. 2821 |
| (N20)NGG | 8 | 48691047 | - | CGGAGCGCCAGGAAAGCCTCAGG | | 3 | 24 | SEQ ID NO. 2822 |
| (N20)NGG | 8 | 48691058 | - | CGAAGTGGGAGCGAGCGCCAGG | | 1 | 15 | SEQ ID NO. 2823 |
| (N20)NGG | 8 | 48691067 | - | GAGAGCTGGCGAAGTGGGAGCGG | | 2 | 91 | SEQ ID NO. 2824 |
| (N20)NGG | 8 | 48691072 | - | AGCGTGAGAGCTGGCGAAGTGGG | | 6 | 12 | SEQ ID NO. 2825 |
| (N20)NGG | 8 | 48691073 | - | GAGCGTGAGAGCTGGCGAAGTGG | | 1 | 26 | SEQ ID NO. 2826 |
| (N20)NGG | 8 | 48691081 | - | GCATATCAGAGCGTGAGAGCTGG | | 1 | 27 | SEQ ID NO. 2827 |
| (N20)NGG | 8 | 48691109 | - | CTCCAATCCGAGGATCCAGTGG | | 2 | 23 | SEQ ID NO. 2828 |
| (N20)NGG | 8 | 48691118 | - | GATGTCTGTCTCCAATCCCGAGG | | 2 | 21 | SEQ ID NO. 2829 |
| (N20)NGG | 8 | 48691159 | - | GATCACGCCGCCAGTCTCCATGG | | 2 | 5 | SEQ ID NO. 2830 |
| (N20)NGG | 8 | 48691210 | - | CAGCAAGTGCACCTGTGTAGCGG | | 1 | 24 | SEQ ID NO. 2831 |
| (N20)NGG | 8 | 48691288 | + | TGTTTCTATTATTAAATCATAGG | | 1 | 240 | SEQ ID NO. 2832 |
| (N20)NGG | 8 | 48691289 | + | GTTTCTATTATTATTAAATCATAGGG | 2 | 4 | 146 | SEQ ID NO. 2833 |
| (N20)NGG | 8 | 48691290 | + | TTTCTATTATTATTAAATCATAGGGG | | 10 | 202 | SEQ ID NO. 2834 |
| (N20)NGG | 8 | 48691343 | - | ACTTACTTTAAGAGATCAGCAGG | | 11 | 45 | SEQ ID NO. 2835 |
| (N20)NGG | 8 | 48691573 | + | TCTCACTCATTAGTGATCCCAGG | | 2 | 28 | SEQ ID NO. 2836 |
| (N20)NGG | 8 | 48691574 | + | CTCACTCATTAGTGATCCCAGGG | | 3 | 36 | SEQ ID NO. 2837 |
| (N20)NGG | 8 | 48691600 | + | CGCCGTGTGAATATAAAGATTGG | | 2 | 5 | SEQ ID NO. 2838 |
| (N20)NGG | 8 | 48691617 | + | GATTGGCTGACAAAAATGTCAGG | 3 | 9 | 59 | SEQ ID NO. 2839 |
| (N20)NGG | 8 | 48691632 | + | ATGTCAGGAAAACATGATGTTGG | 2 | 6 | 92 | SEQ ID NO. 2840 |
| (N20)NGG | 8 | 48691663 | + | ATGTAATGTATAAGTAAGTTTGG | | 1 | 39 | SEQ ID NO. 2841 |
| (N20)NGG | 8 | 48691544 | - | TCACTAATGAGTGAGAAAAGGGG | | 10 | 154 | SEQ ID NO. 2842 |
| (N20)NGG | 8 | 48691545 | - | ATCACTAATGAGTGAGAAAAGGG | | 5 | 139 | SEQ ID NO. 2843 |
| (N20)NGG | 8 | 48691546 | - | GATCACTAATGAGTGAGAAAAGG | | 5 | 66 | SEQ ID NO. 2844 |
| (N20)NGG | 8 | 48691568 | - | TATTCACACGGCGGTGCCCTGGG | | 1 | 7 | SEQ ID NO. 2845 |
| (N20)NGG | 8 | 48691569 | - | ATATTCACACGGCGGTGCCCTGG | | 1 | 4 | SEQ ID NO. 2846 |

FIG. 12 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48691577 | - | CAATCTTTATATTCACACGGCGG | 1 | 2 | 18 | SEQ ID NO. 2847 |
| (N20)NGG | 8 | 48691580 | - | AGCCAATCTTTATATTCACACGG | 1 | 2 | 65 | SEQ ID NO. 2848 |
| (N20)NGG | 8 | 48694722 | + | AACCTTTTATTCTCCCTTTCAGG | 1 | 4 | 95 | SEQ ID NO. 2849 |
| (N20)NGG | 8 | 48694727 | + | TTTATTCTCCCTTTCAGGTTAGG | 1 | 4 | 118 | SEQ ID NO. 2850 |
| (N20)NGG | 8 | 48694740 | + | TCAGGTTAGGATTAATTGAGTGG | 1 | 4 | 46 | SEQ ID NO. 2851 |
| (N20)NGG | 8 | 48694765 | + | TGAAATACTGTTACCTTGAAGG | 1 | 10 | 83 | SEQ ID NO. 2852 |
| (N20)NGG | 8 | 48694795 | + | TTTGAACACCATGTCCAAGAGG | 2 | 3 | 38 | SEQ ID NO. 2853 |
| (N20)NGG | 8 | 48694801 | + | CACCATGTCCAAGAGGAGAAGG | 1 | 7 | 62 | SEQ ID NO. 2854 |
| (N20)NGG | 8 | 48694804 | + | CATGTCCAAGAGGAGAAGGCGG | 1 | 7 | 94 | SEQ ID NO. 2855 |
| (N20)NGG | 8 | 48694815 | + | AGGAGAAGGCGGCTTACCTGAGG | 1 | 2 | 39 | SEQ ID NO. 2856 |
| (N20)NGG | 8 | 48694820 | + | AAGGCGGCTTACCTGAGGTAAGG | 1 | 10 | 658 | SEQ ID NO. 2857 |
| (N20)NGG | 8 | 48694821 | + | AGGCGGCTTACCTGAGGTAAGGG | 1 | 10 | 637 | SEQ ID NO. 2858 |
| (N20)NGG | 8 | 48694824 | + | CGGCTTACCTGAGGTAAGGCGG | 1 | 2 | 21 | SEQ ID NO. 2859 |
| (N20)NGG | 8 | 48694702 | - | AACCTGAAAGGCAGAGAATAAAGG | 1 | 4 | 134 | SEQ ID NO. 2860 |
| (N20)NGG | 8 | 48694713 | - | CAATTAATCCTAACCTGAAAGG | 1 | 3 | 48 | SEQ ID NO. 2861 |
| (N20)NGG | 8 | 48694714 | - | TCAATTAATCCTAACCTGAAAGG | 1 | 2 | 41 | SEQ ID NO. 2862 |
| (N20)NGG | 8 | 48694757 | - | GTTCAAAAGAGAGGTCCTTCAAGG | 1 | 3 | 31 | SEQ ID NO. 2863 |
| (N20)NGG | 8 | 48694767 | - | GGGACATGGTGTTCAAAAGAAGG | 1 | 3 | 53 | SEQ ID NO. 2864 |
| (N20)NGG | 8 | 48694781 | - | CGCCTTCTCCTCTTGGGACATGG | 1 | 4 | 36 | SEQ ID NO. 2865 |
| (N20)NGG | 8 | 48694787 | - | GTAAGCGCCTTCTCCTCTTGGG | 1 | 1 | 16 | SEQ ID NO. 2866 |
| (N20)NGG | 8 | 48694788 | - | GGTAAGCGCCTTCTCCTCTTGG | 1 | 2 | 18 | SEQ ID NO. 2867 |
| (N20)NGG | 8 | 48694809 | - | CGTGTGGCCGCCCTTACCTCAGG | 1 | 3 | 10 | SEQ ID NO. 2868 |
| (N20)NGG | 8 | 48694938 | + | GATGACATTCTGATTTTTGAAGG | 1 | 5 | 91 | SEQ ID NO. 2869 |
| (N20)NGG | 8 | 48694950 | + | ATTTTTGAAGGTGACAGTCATGG | 1 | 3 | 71 | SEQ ID NO. 2870 |
| (N20)NGG | 8 | 48694964 | + | CAGTCATGGCGTCTCTGCGAAGG | 1 | 1 | 7 | SEQ ID NO. 2871 |
| (N20)NGG | 8 | 48694987 | + | CCCAAGCGCATCATCATCCGTGG | 1 | 2 | 2 | SEQ ID NO. 2872 |
| (N20)NGG | 8 | 48695000 | + | TCATCCGTGGCCATGACGAGAGG | 1 | 1 | 9 | SEQ ID NO. 2873 |
| (N20)NGG | 8 | 48695001 | + | CATCCGTGGCCATGACGAGAGGG | 1 | 3 | 12 | SEQ ID NO. 2874 |
| (N20)NGG | 8 | 48695016 | + | CGAGAGGGAACACCCTTTCCTGG | 1 | 3 | 16 | SEQ ID NO. 2875 |
| (N20)NGG | 8 | 48695022 | + | GGAACACCCTTTCCTGGTGAAGG | 1 | 7 | 82 | SEQ ID NO. 2876 |
| (N20)NGG | 8 | 48695023 | + | GAACACCCTTTCCTGGTGAAGGG | 1 | 5 | 53 | SEQ ID NO. 2877 |
| (N20)NGG | 8 | 48695026 | + | CACCCTTTCCTGGTGAAGGGTGG | 1 | 5 | 84 | SEQ ID NO. 2878 |
| (N20)NGG | 8 | 48695031 | + | TTTCCTGGTGAAGGGTGGCGAGG | 1 | 1 | 38 | SEQ ID NO. 2879 |

FIG. 12 cont.

| site type | site chr omosome | site start nucleotide | site strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48695039 | + | TGAAGGGTGCGAGGACCTGCGG | | | 3 | 40 SEQ ID NO. 2880 |
| (N20)NGG | 8 | 48695043 | + | GGGTGGCGAGGACCTGCGGCAGG | 1 | | 1 | 38 SEQ ID NO. 2881 |
| (N20)NGG | 8 | 48695055 | + | CCTGCGGCAGGACCAGCGCGTGG | 1 | | 6 | 32 SEQ ID NO. 2882 |
| (N20)NGG | 8 | 48695070 | + | GCGCGTGGAGCAGCTCTTCCAGG | 1 | | 3 | 24 SEQ ID NO. 2883 |
| (N20)NGG | 8 | 48695080 | + | CAGCTCTTCCAGGTCATGAATGG | 1 | | 6 | 56 SEQ ID NO. 2884 |
| (N20)NGG | 8 | 48695081 | + | AGCTCTTCCAGGTCATGAATGGG | 1 | | 2 | 50 SEQ ID NO. 2885 |
| (N20)NGG | 8 | 48695088 | + | CCAGGTCATGAATGGGATCCTGG | 1 | | 3 | 32 SEQ ID NO. 2886 |
| (N20)NGG | 8 | 48695114 | + | AAGACTCCGCCTGCAGCCAGAGG | 1 | | 3 | 37 SEQ ID NO. 2887 |
| (N20)NGG | 8 | 48695115 | + | AGACTCCGCCTGCAGCCAGAGGG | 1 | | 2 | 26 SEQ ID NO. 2888 |
| (N20)NGG | 8 | 48695129 | + | GCCAGAGGGCCCTGCAGCTGAGG | 1 | | 16 | 148 SEQ ID NO. 2889 |
| (N20)NGG | 8 | 48695159 | + | GCGTTGTGCCATGACCTTCCAGG | 1 | | 1 | 10 SEQ ID NO. 2890 |
| (N20)NGG | 8 | 48695170 | + | ATGACCTTCCAGGTAACTGCCAGG | 2 | | 5 | 28 SEQ ID NO. 2891 |
| (N20)NGG | 8 | 48694965 | - | CCACGGATGATGATGCGCTTGG | 1 | | 1 | 4 SEQ ID NO. 2892 |
| (N20)NGG | 8 | 48694966 | - | GCCACGGATGATGATGCGCTTGG | 1 | | 1 | 10 SEQ ID NO. 2893 |
| (N20)NGG | 8 | 48694982 | - | GTTCCCTCTCTCATGGCCACGG | 1 | | 1 | 9 SEQ ID NO. 2894 |
| (N20)NGG | 8 | 48694988 | - | AAGGGTGTTCCCTCTCGTCATGG | 1 | | 1 | 15 SEQ ID NO. 2895 |
| (N20)NGG | 8 | 48695006 | - | CGCCACCCTTCACCAGGAAAGG | 1 | | 2 | 36 SEQ ID NO. 2896 |
| (N20)NGG | 8 | 48695007 | - | TCGCCACCCTTCACCAGGAAAGG | 1 | | 2 | 25 SEQ ID NO. 2897 |
| (N20)NGG | 8 | 48695012 | - | GGTCCTCGCCACCCTTCACCAGG | 1 | | 1 | 37 SEQ ID NO. 2898 |
| (N20)NGG | 8 | 48695033 | - | CCAGCGCTGGTCCTCGCCGCAGG | 1 | | 4 | 24 SEQ ID NO. 2899 |
| (N20)NGG | 8 | 48695045 | - | GGAAGAGCTGCTCCACGCCTGG | 1 | | 2 | 23 SEQ ID NO. 2900 |
| (N20)NGG | 8 | 48695066 | - | CAGGATCCCATTCATGACCTGG | 1 | | 4 | 44 SEQ ID NO. 2901 |
| (N20)NGG | 8 | 48695084 | - | TGCAGGCGGAGTCTTGGGCAGG | 1 | | 2 | 36 SEQ ID NO. 2902 |
| (N20)NGG | 8 | 48695089 | - | CTGGCTGCAGGCGGAGTCTTGG | 1 | | 4 | 34 SEQ ID NO. 2903 |
| (N20)NGG | 8 | 48695090 | - | TCTGGCTGCAGGCGGAGTCTTGG | 2 | | 2 | 41 SEQ ID NO. 2904 |
| (N20)NGG | 8 | 48695098 | - | CAGGGCCCCTGGCTGCAGGCGG | 1 | | 11 | 187 SEQ ID NO. 2905 |
| (N20)NGG | 8 | 48695101 | - | CTGCAGGGCCCCTGGCTGCAGG | 2 | | 18 | 161 SEQ ID NO. 2906 |
| (N20)NGG | 8 | 48695108 | - | TCCTCAGCTGCAGGGCCCCTGG | 1 | | 12 | 121 SEQ ID NO. 2907 |
| (N20)NGG | 8 | 48695116 | - | GCTATAGGTCCTCAGCTGCAGG | 1 | | 2 | 18 SEQ ID NO. 2908 |
| (N20)NGG | 8 | 48695117 | - | CGCTATAGGTCCTCAGCTGCAGG | 1 | | 1 | 14 SEQ ID NO. 2909 |
| (N20)NGG | 8 | 48695131 | - | GGTCATGGGCACAACGCTATAGG | 1 | | 1 | 9 SEQ ID NO. 2910 |
| (N20)NGG | 8 | 48695145 | - | GGCAGTTACCTGGAGGTCATGG | 1 | | 5 | 55 SEQ ID NO. 2911 |
| (N20)NGG | 8 | 48695146 | - | TGGCAGTTACCTGGAGGTCATGG | 1 | | 6 | 46 SEQ ID NO. 2912 |

FIG. 12 cont.

| site_type | site_chromosome | site_start_nucleotide | site_strand | target_site_sequence with NGG | genome_wide hits with 1 or less mismatches | genome_wide hits with 2 or less mismatches | genome_wide hits with 3 or less mismatches | |
|---|---|---|---|---|---|---|---|---|
| (N20)NGG | 8 | 48695152 | - | GCAGCCTGGCAGTTACCTGGAGG | 1 | 7 | 62 | SEQ ID NO. 2913 |
| (N20)NGG | 8 | 48695155 | - | GGAGCAGCCTGGCAGTTACCTGG | 1 | 4 | 45 | SEQ ID NO. 2914 |
| (N20)NGG | 8 | 48696302 | + | GCAAGGTTCTGGTTTGTTTTAGG | 1 | 2 | 59 | SEQ ID NO. 2915 |
| (N20)NGG | 8 | 48696314 | + | TTTGTTTTAGGTCAGTATGACGG | 1 | 7 | 84 | SEQ ID NO. 2916 |
| (N20)NGG | 8 | 48696318 | + | TTTTAGGTCAGTATGACGGTAGG | 1 | 1 | 8 | SEQ ID NO. 2917 |
| (N20)NGG | 8 | 48696319 | + | TTTAGGTCAGTATGACGGTAGGG | 1 | 3 | 11 | SEQ ID NO. 2918 |
| (N20)NGG | 8 | 48696320 | + | TTAGGTCAGTATGACGGTAGGGG | 1 | 1 | 8 | SEQ ID NO. 2919 |
| (N20)NGG | 8 | 48696356 | + | GAGTACCACGTGCGAATCGCCGG | 1 | 1 | 2 | SEQ ID NO. 2920 |
| (N20)NGG | 8 | 48696357 | + | AGTACCACGTGCGAATCGCCGGG | 1 | 1 | 3 | SEQ ID NO. 2921 |
| (N20)NGG | 8 | 48696369 | + | GAATCGCCGGGTTTGATGAGCGG | 1 | 1 | 4 | SEQ ID NO. 2922 |
| (N20)NGG | 8 | 48696370 | + | AATCGCCGGGTTTGATGAGCGGG | 1 | 1 | 3 | SEQ ID NO. 2923 |
| (N20)NGG | 8 | 48696374 | + | GCCGGGTTTGATGAGCGGGTAGG | 1 | 1 | 8 | SEQ ID NO. 2924 |
| (N20)NGG | 8 | 48696381 | + | TTGATGAGCGGGTAGGTGTGAGG | 1 | 3 | 46 | SEQ ID NO. 2925 |
| (N20)NGG | 8 | 48696382 | + | TGATGAGCGGGTAGGTGTGAGGG | 1 | 1 | 20 | SEQ ID NO. 2926 |
| (N20)NGG | 8 | 48696325 | - | CGCACGTGGTACTCTGGCAATGG | 1 | 1 | 10 | SEQ ID NO. 2927 |
| (N20)NGG | 8 | 48696331 | - | GCGATTCGCACGTGGTACTCTGG | 1 | 1 | 5 | SEQ ID NO. 2928 |
| (N20)NGG | 8 | 48696339 | - | CAAACCCGGCGATTCGCACGTGG | 1 | 1 | 1 | SEQ ID NO. 2929 |
| (N20)NGG | 8 | 48696353 | - | ACCTACCCGCTCATCAAACCCGG | 1 | 1 | 6 | SEQ ID NO. 2930 |
| (N20)NGG | 8 | 48697680 | + | TCTTACTAATTTCAGACTTTTGG | 1 | 7 | 117 | SEQ ID NO. 2931 |
| (N20)NGG | 8 | 48697704 | + | AAAGAATTTGATAAACATTTTGG | 2 | 20 | 413 | SEQ ID NO. 2932 |
| (N20)NGG | 8 | 48697705 | + | AAGAATTTGATAAACATTTTGGG | 1 | 26 | 397 | SEQ ID NO. 2933 |
| (N20)NGG | 8 | 48697710 | + | TTTGATAAACATTTTGGGAAAGG | 1 | 14 | 188 | SEQ ID NO. 2934 |
| (N20)NGG | 8 | 48697713 | + | GATAAACATTTTGGGAAAGGAGG | 1 | 11 | 192 | SEQ ID NO. 2935 |
| (N20)NGG | 8 | 48697803 | + | AACAAAGACTCAAAGCCCCCTGG | 1 | 5 | 32 | SEQ ID NO. 2936 |
| (N20)NGG | 8 | 48697804 | + | ACAAAGACTCAAAGCCCCCTGGG | 1 | 3 | 28 | SEQ ID NO. 2937 |
| (N20)NGG | 8 | 48697828 | + | ATCTGAAAGAATGTTCACCCTGG | 1 | 2 | 43 | SEQ ID NO. 2938 |
| (N20)NGG | 8 | 48697847 | + | CTGGATGAGCGACTTCAAAGTGG | 1 | 2 | 18 | SEQ ID NO. 2939 |
| (N20)NGG | 8 | 48697868 | + | GGAGTTCCTGAGAAATGAGCTGG | 1 | 5 | 56 | SEQ ID NO. 2940 |
| (N20)NGG | 8 | 48697878 | + | AGAAATGAGCTGGAGATTCCCGG | 1 | 3 | 62 | SEQ ID NO. 2941 |
| (N20)NGG | 8 | 48697894 | + | TTCCCGGTGAGTTAACCTCCAGG | 1 | 2 | 12 | SEQ ID NO. 2942 |
| (N20)NGG | 8 | 48697895 | + | TCCCGGTGAGTTAACCTCCAGGG | 1 | 1 | 6 | SEQ ID NO. 2943 |
| (N20)NGG | 8 | 48697896 | + | CCCGGTGAGTTAACCTCCAGGGG | 1 | 1 | 7 | SEQ ID NO. 2944 |
| (N20)NGG | 8 | 48697758 | - | CATTTTAAAAGTAGCATGTTGG | 2 | 14 | 210 | SEQ ID NO. 2945 |

FIG. 12 cont.

| site_type | site_chr omosome | site_start_ nucleotide | site_s trand | target_site_sequence_wi th NGG | genome_wide_ hits_with_1_ or_less_mism atches | genome_wide_ hits_with_ 2_or_less_m ismatches | genome_wide_ hits_with_ or_less_m atches | genome_wide_ hits_with_3_ or_less_mism atches | |
|---|---|---|---|---|---|---|---|---|---|
| (N20)NGG | 8 | 48697796 | - | CATTCTTTCAGATTCCCAGGGGG | | 3 | 10 | 80 | SEQ ID NO. 2946 |
| (N20)NGG | 8 | 48697797 | - | ACATTCTTTCAGATTCCCAGGGG | | 1 | 8 | 82 | SEQ ID NO. 2947 |
| (N20)NGG | 8 | 48697798 | - | AACATTCTTTCAGATTCCCAGGG | | 1 | 6 | 85 | SEQ ID NO. 2948 |
| (N20)NGG | 8 | 48697799 | - | GAACATTCTTTCAGATTCCCAGG | | 1 | 4 | 65 | SEQ ID NO. 2949 |
| (N20)NGG | 8 | 48697823 | - | ACTTTGAAGTCGCTCATCCAGGG | | 1 | 3 | 17 | SEQ ID NO. 2950 |
| (N20)NGG | 8 | 48697824 | - | CACTTTGAAGTCGCTCATCCAGG | | 1 | 1 | 9 | SEQ ID NO. 2951 |
| (N20)NGG | 8 | 48697852 | - | GAATCTCCAGCTCATTTCTCAGG | | 1 | 6 | 53 | SEQ ID NO. 2952 |
| (N20)NGG | 8 | 48697874 | - | CCCCTGGAGTTAACTCACCGGG | | 1 | 1 | 19 | SEQ ID NO. 2953 |
| (N20)NGG | 8 | 48697875 | - | ACCCCTGGAGTTAACTCACCGG | | 1 | 1 | 12 | SEQ ID NO. 2954 |
| (N20)NGG | 8 | 48701466 | + | TACTTTTTTTCCCCTGACAGG | | 2 | 15 | 278 | SEQ ID NO. 2955 |
| (N20)NGG | 8 | 48701471 | + | TTTTTTTCCCTGACAGGATTGG | | 2 | 10 | 115 | SEQ ID NO. 2956 |
| (N20)NGG | 8 | 48701559 | + | TGAAAGAATGTATGCAGCCTTGG | | 1 | 5 | 69 | SEQ ID NO. 2957 |
| (N20)NGG | 8 | 48701560 | + | GAAAGAATGTATGCAGCCTTGGG | | 2 | 6 | 73 | SEQ ID NO. 2958 |
| (N20)NGG | 8 | 48701571 | + | TGCAGCCTTGGGTGACCAAAGG | | 1 | 1 | 34 | SEQ ID NO. 2959 |
| (N20)NGG | 8 | 48701578 | + | TTGGGTGACCAAAGGCTCCAGG | | 1 | 1 | 22 | SEQ ID NO. 2960 |
| (N20)NGG | 8 | 48701583 | + | TGACCCAAAGGCTCCAGGCCTGG | | 1 | 1 | 51 | SEQ ID NO. 2961 |
| (N20)NGG | 8 | 48701584 | + | GACCCAAAGGCTCCAGGCCTGGG | | 1 | 6 | 60 | SEQ ID NO. 2962 |
| (N20)NGG | 8 | 48701585 | + | ACCCAAAGGCTCCAGGCCTGGGG | | 1 | 7 | 91 | SEQ ID NO. 2963 |
| (N20)NGG | 8 | 48701586 | + | CCCAAAGGCTCCAGGCCTGGGGG | | 2 | 7 | 103 | SEQ ID NO. 2964 |
| (N20)NGG | 8 | 48701597 | + | CAGGCCTGGGGGCCTTTAGAAGG | | 3 | 9 | 59 | SEQ ID NO. 2965 |
| (N20)NGG | 8 | 48701610 | + | CTTTAGAAGGAAGTTTATTCAGG | | 1 | 7 | 78 | SEQ ID NO. 2966 |
| (N20)NGG | 8 | 48701615 | + | GAAGAAGTTTATTCAGGTATGG | | 1 | 3 | 69 | SEQ ID NO. 2967 |
| (N20)NGG | 8 | 48701620 | + | AAGTTTATTCAGTATGGACTGG | | 1 | 4 | 19 | SEQ ID NO. 2968 |
| (N20)NGG | 8 | 48701456 | - | CATTGCTCCAATCCTGTCAGGG | | 1 | 2 | 38 | SEQ ID NO. 2969 |
| (N20)NGG | 8 | 48701457 | - | TCATTGCTCCAATCCTGTCAGG | | 1 | 3 | 21 | SEQ ID NO. 2970 |
| (N20)NGG | 8 | 48701458 | - | ATCATTGCTCCAATCCTGTCAG | | 1 | 2 | 36 | SEQ ID NO. 2971 |
| (N20)NGG | 8 | 48701503 | - | AATGTTTTTTTTTATTTACAGGG | | 1 | 47 | 1234 | SEQ ID NO. 2972 |
| (N20)NGG | 8 | 48701504 | - | CAATGTTTTTTTTATTTACAGG | | 1 | 22 | 559 | SEQ ID NO. 2973 |
| (N20)NGG | 8 | 48701505 | - | TCAATGTTTTTTTTATTTACAG | | 1 | 14 | 413 | SEQ ID NO. 2974 |
| (N20)NGG | 8 | 48701554 | - | TGGAGCCTTTGGGTCACCCAAGG | | 1 | 4 | 40 | SEQ ID NO. 2975 |
| (N20)NGG | 8 | 48701564 | - | CCCCAGGCCTGGAGCCTTTGGG | | 2 | 8 | 86 | SEQ ID NO. 2976 |
| (N20)NGG | 8 | 48701565 | - | GCCCCAGGCCTGGAGCCTTTGG | | 1 | 10 | 133 | SEQ ID NO. 2977 |
| (N20)NGG | 8 | 48701574 | - | CTTCTAAAGGCCCCCAGGCCTGG | | 1 | 3 | 36 | SEQ ID NO. 2978 |

FIG. 12 cont.

| site_type | site_chr omosome | site_start_ nucleotide | site_s trand | target_site_sequence_wi th_NGG | genome_wide_ hits_with_1_ or_less_mism atches | genome_wide_ hits_with_ 2_or_less_m ismatches | genome_wide_ hits_with_3 _or_less_mism atches | | |
|---|---|---|---|---|---|---|---|---|---|
| (N20)NGG | 8 | 48701579 | - | ACTTCCTTCTAAAGGCCCCAGG | 1 | 2 | 39 | SEQ ID NO. | 2979 |
| (N20)NGG | 8 | 48701587 | - | CTGAATAAACTTCCTTCTAAAGG | 1 | 4 | 60 | SEQ ID NO. | 2980 |
| (N20)NGG | 8 | 48701711 | + | CTTTGTAAATTTTTTTAAATAGG | 3 | 81 | 973 | SEQ ID NO. | 2981 |
| (N20)NGG | 8 | 48701727 | + | AAATAGGATTAAAAGTAAGTTGG | 1 | 6 | 140 | SEQ ID NO. | 2982 |
| (N20)NGG | 8 | 48701734 | + | ATTAAAAGTAAGTTGGATCAAGG | 1 | 8 | 84 | SEQ ID NO. | 2983 |
| (N20)NGG | 8 | 48701737 | + | AAAAGTAAGTTGGATCAAGGAGG | 1 | 4 | 54 | SEQ ID NO. | 2984 |
| (N20)NGG | 8 | 48701799 | + | TAATCCTGAACTGCTCTTTAAGG | 1 | 3 | 37 | SEQ ID NO. | 2985 |
| (N20)NGG | 8 | 48701813 | + | TCTTTAAGGTAATGATAGAACGG | 1 | 4 | 110 | SEQ ID NO. | 2986 |
| (N20)NGG | 8 | 48701820 | + | GGTAATGATAGAACGGCTTCTGG | 1 | 1 | 3 | SEQ ID NO. | 2987 |
| (N20)NGG | 8 | 48701761 | - | AGGATTAGAGAGCTGATCTAAGG | 1 | 2 | 27 | SEQ ID NO. | 2988 |
| (N20)NGG | 8 | 48701781 | - | ATTACCTTAAAGAGCAGTTCAGG | 1 | 1 | 37 | SEQ ID NO. | 2989 |
| (N20)NGG | 8 | 48706870 | + | AGATCTCTTCCGTTCCTCTGCTGG | 1 | 1 | 22 | SEQ ID NO. | 2990 |
| (N20)NGG | 8 | 48706885 | + | CCTGCTGGCAGTTCATCAGCTGG | 1 | 2 | 28 | SEQ ID NO. | 2991 |
| (N20)NGG | 8 | 48706898 | + | CATCAGCTGGATCAGCCACATGG | 1 | 6 | 39 | SEQ ID NO. | 2992 |
| (N20)NGG | 8 | 48706901 | + | CAGCTGGATCAGCCACATGTGG | 1 | 3 | 53 | SEQ ID NO. | 2993 |
| (N20)NGG | 8 | 48706910 | + | CAGCCACATGTGGCCTTACTGG | 1 | 5 | 51 | SEQ ID NO. | 2994 |
| (N20)NGG | 8 | 48706946 | + | CGTTGCTGTTCAGCACTCTGTGG | 1 | 3 | 17 | SEQ ID NO. | 2995 |
| (N20)NGG | 8 | 48706973 | + | AATCACTGATAACTACCCGCAGG | | 1 | 6 | SEQ ID NO. | 2996 |
| (N20)NGG | 8 | 48707021 | + | CAGCGAAAGCTATTCCTTCAAGG | | 2 | 21 | SEQ ID NO. | 2997 |
| (N20)NGG | 8 | 48707034 | + | TCCTTCAAGGATAACTTCTACTGG | | 2 | 23 | SEQ ID NO. | 2998 |
| (N20)NGG | 8 | 48707048 | + | TTCTACTGGTCATAAGAATAAGG | | 1 | 31 | SEQ ID NO. | 2999 |
| (N20)NGG | 8 | 48707057 | + | TCATAAGAATAAGGAGTTTGTGG | | 3 | 66 | SEQ ID NO. | 3000 |
| (N20)NGG | 8 | 48707062 | + | AGAATAAGGAGTTTGTGGCAAGG | | 7 | 95 | SEQ ID NO. | 3001 |
| (N20)NGG | 8 | 48707066 | + | TAAGGAGTTTGTGGCAAGGTAGG | 1 | 3 | 51 | SEQ ID NO. | 3002 |
| (N20)NGG | 8 | 48707081 | + | AAGGTAGGTAATATTACAGAAGG | 2 | 5 | 71 | SEQ ID NO. | 3003 |
| (N20)NGG | 8 | 48706857 | - | GATGAACTGCCAGCAGGGAACGG | 2 | 4 | 64 | SEQ ID NO. | 3004 |
| (N20)NGG | 8 | 48706862 | - | CAGCTGATGAACTGCCAGCAGG | 1 | 2 | 78 | SEQ ID NO. | 3005 |
| (N20)NGG | 8 | 48706863 | - | CCAGCTGATGAACTGCCAGCAGG | 1 | 2 | 35 | SEQ ID NO. | 3006 |
| (N20)NGG | 8 | 48706891 | - | TGTCCAGTAAGGCCACCATGTGG | 1 | 3 | 31 | SEQ ID NO. | 3007 |
| (N20)NGG | 8 | 48706902 | - | GGCTTGGTCTTTGTCCAGTAAGG | 1 | 3 | 28 | SEQ ID NO. | 3008 |
| (N20)NGG | 8 | 48706918 | - | AGTGCTGAACAGCAACGGCTTGG | 1 | 2 | 14 | SEQ ID NO. | 3009 |
| (N20)NGG | 8 | 48706923 | - | CACAGAGTGCTGAACAGCAACGG | 1 | 6 | 66 | SEQ ID NO. | 3010 |
| (N20)NGG | 8 | 48706966 | - | AGGGATAAACAATAGCCTGCGGG | 1 | 1 | 24 | SEQ ID NO. | 3011 |

FIG. 12 cont.

| site_type | site_chr omosome | site_start_ nucleotide | site_s trand | target_site_sequence_wi th_NGG | genome_wide_ hits_with_1 or_less_mism atches | genome_wide_ hits_with_2_or_less_m ismatches | genome_wide_ hits_with_3_or_less_mism atches | |
|---|---|---|---|---|---|---|---|---|
| (N20)NGG | 8 | 48706967 | - | AAGGGATAAACAATAGCCTGCGG | | 1 | 5 | 37 SEQ ID NO. 3012 |
| (N20)NGG | 8 | 48706985 | - | CTTTCGCTGCTTATGATGAAGGG | | 1 | 1 | 11 SEQ ID NO. 3013 |
| (N20)NGG | 8 | 48706986 | - | GCTTTCGCTGCTTATGATGAAGG | | 1 | 1 | 15 SEQ ID NO. 3014 |
| (N20)NGG | 8 | 48707013 | - | ACCAGTAGAAGTATCCTTGAAGG | | 1 | 1 | 18 SEQ ID NO. 3015 |
| (N20)NGG | 8 | 48710820 | + | TATTGATTCTGCAGAACTGCAGG | | 1 | 2 | 62 SEQ ID NO. 3016 |
| (N20)NGG | 8 | 48710838 | + | GCAGGCGTATCCAGCACTTGTGG | | 1 | 2 | 12 SEQ ID NO. 3017 |
| (N20)NGG | 8 | 48710841 | + | GGCGTATCCAGCACTTGTGGTGG | | 1 | 1 | 3 SEQ ID NO. 3018 |
| (N20)NGG | 8 | 48710921 | + | GATTACTTCAGATTATAGAACGG | | 1 | 5 | 80 SEQ ID NO. 3019 |
| (N20)NGG | 8 | 48710931 | + | GATTATAGAACGGTATCCAGAGG | | 1 | 1 | 10 SEQ ID NO. 3020 |
| (N20)NGG | 8 | 48710958 | + | TTTGAGCCTCATGACAAAAGAGG | | 1 | 4 | 43 SEQ ID NO. 3021 |
| (N20)NGG | 8 | 48710962 | + | AGCCTCATGACAAAAGAGGTTGG | | 1 | 3 | 30 SEQ ID NO. 3022 |
| (N20)NGG | 8 | 48710980 | + | GTTGGTGTCTTTATTCTACTTGG | | 1 | 2 | 45 SEQ ID NO. 3023 |
| (N20)NGG | 8 | 48710788 | - | TGCAGAATCAATAACTATCAAGG | | 2 | 3 | 45 SEQ ID NO. 3024 |
| (N20)NGG | 8 | 48710826 | - | ATTTTCTCCACCACAAGTGCTGG | | 1 | 1 | 39 SEQ ID NO. 3025 |
| (N20)NGG | 8 | 48710872 | - | AAACTTCAATCTGGCTTCATTGG | | 1 | 3 | 56 SEQ ID NO. 3026 |
| (N20)NGG | 8 | 48710881 | - | TAACTTAGGAAACTTCAATCTGG | | 1 | 3 | 49 SEQ ID NO. 3027 |
| (N20)NGG | 8 | 48710895 | - | TCTATAATCTGAAGTAATCTAGG | | 2 | 6 | 57 SEQ ID NO. 3028 |
| (N20)NGG | 8 | 48710925 | - | ATGAGGCTCAAAGTCTCCTCTGG | | 1 | 2 | 36 SEQ ID NO. 3029 |
| (N20)NGG | 8 | 48710942 | - | CACCAACCTCTTTTGTCATGAGG | | 1 | 3 | 37 SEQ ID NO. 3030 |
| (N20)NGG | 8 | 48711770 | + | TTTAGGTCTCTGTGAATTCCAGG | | 1 | 2 | 50 SEQ ID NO. 3031 |
| (N20)NGG | 8 | 48711779 | + | CTGTGAATTCCAGTGATCGCGG | | 1 | 3 | 22 SEQ ID NO. 3032 |
| (N20)NGG | 8 | 48711780 | + | TGTGAATTCCAGTGATCGCGGG | | 1 | 2 | 16 SEQ ID NO. 3033 |
| (N20)NGG | 8 | 48711815 | + | AGCATTCCAGCACCTCTCTGAGG | | 1 | 4 | 50 SEQ ID NO. 3034 |
| (N20)NGG | 8 | 48711824 | + | GCACCTCTCTGAGGCTGTGCAGG | | 1 | 1 | 68 SEQ ID NO. 3035 |
| (N20)NGG | 8 | 48711827 | + | CCTCTCTGAGGCTGTGCAGGCGG | | 1 | 12 | 134 SEQ ID NO. 3036 |
| (N20)NGG | 8 | 48711833 | + | TGAGGCTGTGCAGGCGGCTGAGG | | 1 | 6 | 97 SEQ ID NO. 3037 |
| (N20)NGG | 8 | 48711836 | + | GGCTGTGCAGGCGGCTGAGGAGG | | 1 | 37 | 893 SEQ ID NO. 3038 |
| (N20)NGG | 8 | 48711839 | + | TGTGCAGGCGGCTGAGGAGGAGG | | 1 | 18 | 407 SEQ ID NO. 3039 |
| (N20)NGG | 8 | 48711856 | + | AGGAGGCCCAGCCTCCCTCCTGG | | 6 | 14 | 129 SEQ ID NO. 3040 |
| (N20)NGG | 8 | 48711864 | + | CAGCCTCCCTCCTGGAGCTGTGG | | 3 | 18 | 180 SEQ ID NO. 3041 |
| (N20)NGG | 8 | 48711865 | + | AGCCTCCCTCCTGGAGCTGTGGG | | 2 | 14 | 98 SEQ ID NO. 3042 |
| (N20)NGG | 8 | 48711876 | + | TGGAGCTGTGGGCCTGCAGCTGG | | 2 | 14 | 122 SEQ ID NO. 3043 |
| (N20)NGG | 8 | 48711877 | + | GGAGCTGTGGGCCTGCAGCTGGG | | 1 | 19 | 138 SEQ ID NO. 3044 |

FIG. 12 cont.

| site_type | site_chr omosome | site_start_ nucleotide | site_s trand | target_site_sequence_wi th NGG | genome_wide_ hits_with_1_ or_less_mism atches | genome_wide_ hits_with_ 2_or_less_m ismatches | genome_wide_ hits_with_3_ or_less_mism atches | | |
|---|---|---|---|---|---|---|---|---|---|
| (N20)NGG | 8 | 48711878 | + | GAGCTGTGGGCCTGCAGCTGGGG | | 1 | 10 | 148 | SEQ ID NO. 3045 |
| (N20)NGG | 8 | 48711902 | + | GATTGATGTTACATGACGCTGG | 1 | | 1 | 7 | SEQ ID NO. 3046 |
| (N20)NGG | 8 | 48711932 | + | CTGTGACCAACAGCTGCGCAAGG | 1 | | 2 | 29 | SEQ ID NO. 3047 |
| (N20)NGG | 8 | 48711935 | + | TGACCAACAGCTGCGCAAGGAGG | 1 | | 2 | 23 | SEQ ID NO. 3048 |
| (N20)NGG | 8 | 48711951 | + | AAGGAGGAAGAGAATGCATCAGG | 1 | | 6 | 147 | SEQ ID NO. 3049 |
| (N20)NGG | 8 | 48711766 | - | GGTACAGACCCGCGATCACCTGG | 1 | | 1 | 3 | SEQ ID NO. 3050 |
| (N20)NGG | 8 | 48711787 | - | AGAGGTGCTGAAATGCTCTCTGG | 1 | | 4 | 32 | SEQ ID NO. 3051 |
| (N20)NGG | 8 | 48711799 | - | GCACAGCCTCAGAGAGGTGCTGG | 1 | | 4 | 84 | SEQ ID NO. 3052 |
| (N20)NGG | 8 | 48711805 | - | CCGCCTGCACAGCCTCAGAGAGG | 1 | | 3 | 61 | SEQ ID NO. 3053 |
| (N20)NGG | 8 | 48711840 | - | ACAGCTCCAGAGGGAGGCTGGG | 2 | | 13 | 114 | SEQ ID NO. 3054 |
| (N20)NGG | 8 | 48711841 | - | CACAGCTCCAGGAGGGAGGCTGG | 2 | | 14 | 149 | SEQ ID NO. 3055 |
| (N20)NGG | 8 | 48711845 | - | GGCCCACAGCTCCAGGAGGGAGG | 1 | | 18 | 172 | SEQ ID NO. 3056 |
| (N20)NGG | 8 | 48711848 | - | GCAGGCCCACAGCTCCAGGAGGG | 1 | | 8 | 101 | SEQ ID NO. 3057 |
| (N20)NGG | 8 | 48711849 | - | TGCAGGCCCACAGCTCCAGGAGG | 2 | | 11 | 104 | SEQ ID NO. 3058 |
| (N20)NGG | 8 | 48711852 | - | AGCTGCAGGCCCACAGCTCCAGG | 2 | | 17 | 119 | SEQ ID NO. 3059 |
| (N20)NGG | 8 | 48711866 | - | GCATCAATCACCCCAGCTGCAGG | 1 | | 1 | 32 | SEQ ID NO. 3060 |
| (N20)NGG | 8 | 48711916 | - | CTTCCTCCTTGCGCAGCTGTTGG | 1 | | 2 | 55 | SEQ ID NO. 3061 |
| (N20)NGG | 8 | 48713394 | + | CTACTTAAGCAAAATATTCTGG | 1 | | 7 | 87 | SEQ ID NO. 3062 |
| (N20)NGG | 8 | 48713421 | + | CCGTGACCAGAACATTCTCTTGG | 2 | | 6 | 31 | SEQ ID NO. 3063 |
| (N20)NGG | 8 | 48713422 | + | CGTGACCAGAACATTCTCTTGGG | 1 | | 5 | 33 | SEQ ID NO. 3064 |
| (N20)NGG | 8 | 48713435 | + | TTCTCTTGGGTACAACTTACAGG | 1 | | 3 | 35 | SEQ ID NO. 3065 |
| (N20)NGG | 8 | 48713487 | + | AGCCTGCCTTGCTGAAATCGAGG | 1 | | 2 | 21 | SEQ ID NO. 3066 |
| (N20)NGG | 8 | 48713490 | + | CTGCCTTGCTGAAATCGAGGAGG | 1 | | 1 | 24 | SEQ ID NO. 3067 |
| (N20)NGG | 8 | 48713496 | + | TGCTGAAATCGAGGAGGACAAGG | 1 | | 3 | 23 | SEQ ID NO. 3068 |
| (N20)NGG | 8 | 48713521 | + | AGAAGAATCTTAGAGCTTTCTGG | 1 | | 6 | 67 | SEQ ID NO. 3069 |
| (N20)NGG | 8 | 48713535 | + | GCTTTCTGGATCCAGTTCAGAGG | 1 | | 2 | 39 | SEQ ID NO. 3070 |
| (N20)NGG | 8 | 48713547 | + | CAGTTCAGAGATTCAGAGAAGG | 1 | | 5 | 92 | SEQ ID NO. 3071 |
| (N20)NGG | 8 | 48713556 | + | GGATTCAGAGAAGGTAATACTGG | 1 | | 3 | 47 | SEQ ID NO. 3072 |
| (N20)NGG | 8 | 48713559 | + | TTCAGAGAAGGTAATACTGGAGG | 1 | | 4 | 64 | SEQ ID NO. 3073 |
| (N20)NGG | 8 | 48713346 | - | GACACGTTGTTCTCATCTGTTGG | 1 | | 2 | 26 | SEQ ID NO. 3074 |
| (N20)NGG | 8 | 48713399 | - | CCAAGAATGTTCTGGTCACGG | 1 | | 7 | 53 | SEQ ID NO. 3075 |
| (N20)NGG | 8 | 48713405 | - | TTGTACCCAAGAATGTTCTGG | | 1 | 3 | 36 | SEQ ID NO. 3076 |
| (N20)NGG | 8 | 48713463 | - | TCGATTTCAGCAAGGCAGGCTGG | 1 | | 2 | 17 | SEQ ID NO. 3077 |

FIG. 12 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48713467 | - | CTCCTCGATTTCAGCAAGGCAGG | 1 | 1 | 19 | SEQ ID NO. 3078 |
| (N20)NGG | 8 | 48713471 | - | TGTCCTCCTCGATTTCAGCAAGG | 1 | 2 | 17 | SEQ ID NO. 3079 |
| (N20)NGG | 8 | 48713524 | - | CTTCTCTGAATCCTCTGAACTGG | 2 | 5 | 57 | SEQ ID NO. 3080 |
| (N20)NGG | 8 | 48715899 | + | ACTTGCTATGAAACTACTGAAGG | 1 | 4 | 45 | SEQ ID NO. 3081 |
| (N20)NGG | 8 | 48715934 | + | AGTCAAAAACCAGAGACGATTGG | 1 | 2 | 43 | SEQ ID NO. 3082 |
| (N20)NGG | 8 | 48715938 | + | AAAAACCAGACGATTGGCTGG | 1 | 3 | 30 | SEQ ID NO. 3083 |
| (N20)NGG | 8 | 48715946 | + | GAGACGATTGGCTGCTGAGCTGG | 1 | 1 | 30 | SEQ ID NO. 3084 |
| (N20)NGG | 8 | 48715947 | + | AGACGATTGGCTGGTGAGCTGGG | 1 | 2 | 21 | SEQ ID NO. 3085 |
| (N20)NGG | 8 | 48715979 | + | ACTGCGCCTGAGCCACTGCCGG | 1 | 3 | 39 | SEQ ID NO. 3086 |
| (N20)NGG | 8 | 48715985 | + | GCCTGAGCCACTGCCGGAGCCGG | 1 | 20 | 98 | SEQ ID NO. 3087 |
| (N20)NGG | 8 | 48715992 | + | CCACTGCCGGAGCCGGTCCCAGG | 1 | 2 | 14 | SEQ ID NO. 3088 |
| (N20)NGG | 8 | 48715993 | + | CACTGCCGGAGCCGGTCCCAGGG | 1 | 3 | 24 | SEQ ID NO. 3089 |
| (N20)NGG | 8 | 48716007 | + | GTCCCAGGGCTGCTCTGAGCAGG | 2 | 15 | 239 | SEQ ID NO. 3090 |
| (N20)NGG | 8 | 48716040 | + | GCTGAAAACAGTCTCTTTGTTGG | 1 | 7 | 89 | SEQ ID NO. 3091 |
| (N20)NGG | 8 | 48716041 | + | CTGAAAACAGTCTCTTTTGTTGGG | 1 | 8 | 89 | SEQ ID NO. 3092 |
| (N20)NGG | 8 | 48715921 | - | GCTCACCAGCCAATCGTCTCTGG | 1 | 1 | 14 | SEQ ID NO. 3093 |
| (N20)NGG | 8 | 48715961 | - | GGCTCCGGCCAGTGGCTCAGGCGG | 1 | 20 | 66 | SEQ ID NO. 3094 |
| (N20)NGG | 8 | 48715964 | - | ACCGGCTCCGGCCAGTGGCTCAGG | 1 | 4 | 40 | SEQ ID NO. 3095 |
| (N20)NGG | 8 | 48715970 | - | CCTGGACCGGCTCCGGCAGTGG | 2 | 5 | 33 | SEQ ID NO. 3096 |
| (N20)NGG | 8 | 48715976 | - | AGCAGCCCTGGACCGGCTCCGG | 1 | 3 | 56 | SEQ ID NO. 3097 |
| (N20)NGG | 8 | 48715982 | - | GCTCAGAGCAGCCCTGGGACCGG | 1 | 7 | 141 | SEQ ID NO. 3098 |
| (N20)NGG | 8 | 48715987 | - | CACCTGCTCAGAGCAGCCCTGGG | 2 | 11 | 145 | SEQ ID NO. 3099 |
| (N20)NGG | 8 | 48715988 | - | GCACCTGCTCAGAGCAGCCCTGG | 1 | 5 | 98 | SEQ ID NO. 3100 |
| (N20)NGG | 8 | 48719722 | + | TTTCTTTCTCAGCAAAATAGAGG | 2 | 19 | 253 | SEQ ID NO. 3101 |
| (N20)NGG | 8 | 48719764 | + | AGAAGATAATAGTATGAATGTGG | 1 | 6 | 95 | SEQ ID NO. 3102 |
| (N20)NGG | 8 | 48719774 | + | AGTATGAATGTGATCAAGATGG | 2 | 3 | 58 | SEQ ID NO. 3103 |
| (N20)NGG | 8 | 48719790 | + | AAGATGGACCCCAGTGACAGG | 1 | 3 | 40 | SEQ ID NO. 3104 |
| (N20)NGG | 8 | 48719794 | + | TGGAGACCCCAGTGACAGGATGG | 2 | 9 | 81 | SEQ ID NO. 3105 |
| (N20)NGG | 8 | 48719809 | + | CAGGATGGAAGTGCAAGAGCAGG | 2 | 8 | 126 | SEQ ID NO. 3106 |
| (N20)NGG | 8 | 48719835 | + | AAGATATCAGCTCCCTGATCAGG | 1 | 1 | 23 | SEQ ID NO. 3107 |
| (N20)NGG | 8 | 48719880 | + | TGAAGATAGACAGTGCCCGG | 1 | 3 | 40 | SEQ ID NO. 3108 |
| (N20)NGG | 8 | 48719887 | + | GATAGACAGTGCCCGGAAGCAGG | 1 | 1 | 11 | SEQ ID NO. 3109 |
| (N20)NGG | 8 | 48719890 | + | AGACAGTGCCCGGAAGCAGGTGG | 1 | 4 | 45 | SEQ ID NO. 3110 |

FIG. 12 cont.

| site type | site_chr omosome | site_start_ nucleotide | site s trand | target_site_sequence_wi th NGG | genome_wide_ hits_with_1_ or_less_mism atches | genome_wide_ hits_with_ 2_or_less_m ismatches | genome_wide_ hits_with_3_ or_less_mism atches | | |
|---|---|---|---|---|---|---|---|---|---|
| (N20)NGG | 8 | 48719891 | + | GACAGTGCCCGAAGCAGTGG | | 1 | 2 | 29 | SEQ ID NO. 3111 |
| (N20)NGG | 8 | 48719732 | - | ACTATTATCTTCTGGAAGAGGG | | 1 | 10 | 71 | SEQ ID NO. 3112 |
| (N20)NGG | 8 | 48719733 | - | TACTATTATCTTCTGGAAGAGG | | 1 | 4 | 79 | SEQ ID NO. 3113 |
| (N20)NGG | 8 | 48719734 | - | ATACTATTATCTTCTGGAAGAG | | 1 | 3 | 56 | SEQ ID NO. 3114 |
| (N20)NGG | 8 | 48719740 | - | ACATTCATACTATTATCTTCTG | | 1 | 6 | 173 | SEQ ID NO. 3115 |
| (N20)NGG | 8 | 48719778 | - | GCACTTCCATCCTGTCACTGGG | | 1 | 3 | 33 | SEQ ID NO. 3116 |
| (N20)NGG | 8 | 48719779 | - | TGCACTTCCATCCTGTCACTGG | | 1 | 2 | 25 | SEQ ID NO. 3117 |
| (N20)NGG | 8 | 48719780 | - | TTGCACTTCCATCCTGTCACTG | | 2 | 4 | 26 | SEQ ID NO. 3118 |
| (N20)NGG | 8 | 48719825 | - | AAACTTGCAACTCCTGATCAGG | | 1 | 1 | 30 | SEQ ID NO. 3119 |
| (N20)NGG | 8 | 48719826 | - | AAAACTTGCAACTCCTGATCAG | | 1 | 3 | 23 | SEQ ID NO. 3120 |
| (N20)NGG | 8 | 48719849 | - | GTCTATCATCTTCATTTTCATGG | | 1 | 10 | 115 | SEQ ID NO. 3121 |
| (N20)NGG | 8 | 48719876 | - | ACGAGTACCCACCTGCTTCCGG | | 1 | 1 | 11 | SEQ ID NO. 3122 |
| (N20)NGG | 8 | 48719877 | - | CACGAGTACCCACCTGCTTCCG | | 1 | 1 | 12 | SEQ ID NO. 3123 |
| (N20)NGG | 8 | 48730010 | + | CACCCTCTAATACTATTTTAGG | | 1 | 4 | 61 | SEQ ID NO. 3124 |
| (N20)NGG | 8 | 48730056 | + | TTAAGAGACTTCTGAACACCTGG | | 1 | 5 | 47 | SEQ ID NO. 3125 |
| (N20)NGG | 8 | 48730084 | + | CAGATATCCAGATGCTAAAATGG | | 1 | 2 | 78 | SEQ ID NO. 3126 |
| (N20)NGG | 8 | 48730101 | + | AAATGGACCCAATGAACATCTG | | 1 | 3 | 67 | SEQ ID NO. 3127 |
| (N20)NGG | 8 | 48730102 | + | AATGGACCCAATGAACATCTGG | | 1 | 3 | 39 | SEQ ID NO. 3128 |
| (N20)NGG | 8 | 48730122 | + | GGGATGACATCATCACACAAATCGG | | 1 | 2 | 37 | SEQ ID NO. 3129 |
| (N20)NGG | 8 | 48730132 | + | CATCACAAATCGTAAGACGTGG | | 1 | 1 | 9 | SEQ ID NO. 3130 |
| (N20)NGG | 8 | 48729990 | - | TGCCTAAAAATAGTATTAGAGGG | | 1 | 4 | 74 | SEQ ID NO. 3131 |
| (N20)NGG | 8 | 48729991 | - | TTGCCTAAAAATAGTATTAGAG | | 1 | 2 | 75 | SEQ ID NO. 3132 |
| (N20)NGG | 8 | 48730030 | - | GTGTTCAGAAGTCTCTTAAGGG | | 1 | 3 | 45 | SEQ ID NO. 3133 |
| (N20)NGG | 8 | 48730031 | - | GGTGTTCAGAAGTCTCTTAAGG | | 1 | 3 | 34 | SEQ ID NO. 3134 |
| (N20)NGG | 8 | 48730032 | - | AGGTGTTCAGAAGTCTCTTAAG | | 1 | 8 | 49 | SEQ ID NO. 3135 |
| (N20)NGG | 8 | 48730052 | - | ATCTGGATATCTGTTTGTCCAGG | | 1 | 6 | 143 | SEQ ID NO. 3136 |
| (N20)NGG | 8 | 48730069 | - | ATTGGGTCCATTTTAGCATCTGG | | 1 | 1 | 19 | SEQ ID NO. 3137 |
| (N20)NGG | 8 | 48730086 | - | TGTCATCCCAGATGTTCATTGGG | | 1 | 3 | 30 | SEQ ID NO. 3138 |
| (N20)NGG | 8 | 48730087 | - | ATGTCATCCCAGATGTTCATTGG | | 1 | 1 | 34 | SEQ ID NO. 3139 |
| (N20)NGG | 8 | 48732025 | + | CACCAAATTGCAGTCTGTACAGG | | 1 | 1 | 26 | SEQ ID NO. 3140 |
| (N20)NGG | 8 | 48732043 | + | ACAGGCTTTAACAGAAATTCAGG | | 1 | 2 | 51 | SEQ ID NO. 3141 |
| (N20)NGG | 8 | 48732071 | + | ATCAGCTTTATAAGCAAACAAGG | | 1 | 4 | 65 | SEQ ID NO. 3142 |
| (N20)NGG | 8 | 48732087 | + | AACAAGGTAATTTTTTCATCGG | | 1 | 17 | 171 | SEQ ID NO. 3143 |

FIG. 12 cont.

| site_type | site_chr omosome | site_start_ nucleotide | site s trand | target_site_sequence wi th NGG | genome_wide_ hits_with_1_ or_less_mism atches | genome_wide_ hits_with_ 2_or_less_m ismatches | genome_wide_ hits_with_3_ or_less_mism atches | | |
|---|---|---|---|---|---|---|---|---|---|
| (N20)NGG | 8 | 48731982 | - | TGAGTCTACTTTGGTGTAAGAGG | 1 | 3 | 26 | SEQ ID NO. | 3144 |
| (N20)NGG | 8 | 48731991 | - | GCAATTTGGTGAGTCTACTTTGG | 1 | 4 | 21 | SEQ ID NO. | 3145 |
| (N20)NGG | 8 | 48732005 | - | AGCCTGTACAGACTGCAATTTGG | 1 | 3 | 21 | SEQ ID NO. | 3146 |
| (N20)NGG | 8 | 48733279 | + | AGTATATTTTATGTTCCTTAGG | 3 | 21 | 253 | SEQ ID NO. | 3147 |
| (N20)NGG | 8 | 48733330 | + | CAAGCTGAAGCTGCTGCTCCAGG | 2 | 13 | 138 | SEQ ID NO. | 3148 |
| (N20)NGG | 8 | 48733331 | + | AAGCTGAAGCTGCTGCTCCAGG | 4 | 30 | 315 | SEQ ID NO. | 3149 |
| (N20)NGG | 8 | 48733336 | + | GAAGCTGCTGCTCCAGGAGAGG | 2 | 9 | 186 | SEQ ID NO. | 3150 |
| (N20)NGG | 8 | 48733379 | + | TTTATTGACAAAGCTATGCACGG | 1 | 6 | 76 | SEQ ID NO. | 3151 |
| (N20)NGG | 8 | 48733380 | + | TTATTGACAAAGCTATGCACGGG | 1 | 1 | 29 | SEQ ID NO. | 3152 |
| (N20)NGG | 8 | 48733381 | + | TATTGACAAAGCTATGCACGGGG | 1 | 1 | 18 | SEQ ID NO. | 3153 |
| (N20)NGG | 8 | 48733393 | + | TATGCACGGGGAGCTCCAGAGG | 1 | 5 | 26 | SEQ ID NO. | 3154 |
| (N20)NGG | 8 | 48733484 | + | GCCAAATATTACATTCAAAATGG | 1 | 7 | 127 | SEQ ID NO. | 3155 |
| (N20)NGG | 8 | 48733504 | + | TGGCATTCAGAGTTTTATGCAGG | 1 | 4 | 34 | SEQ ID NO. | 3156 |
| (N20)NGG | 8 | 48733273 | - | TAAGGTAGATATGTTCCTAAGG | 1 | 3 | 54 | SEQ ID NO. | 3157 |
| (N20)NGG | 8 | 48733291 | - | AGCTTGCTGCGGATCATGTAAGG | 1 | 1 | 7 | SEQ ID NO. | 3158 |
| (N20)NGG | 8 | 48733302 | - | GCAGCAGCTTCAGCTTGCTGCGG | 1 | 8 | 96 | SEQ ID NO. | 3159 |
| (N20)NGG | 8 | 48733326 | - | GGGACTGGTCAGCCTCTCCCTGG | 1 | 4 | 41 | SEQ ID NO. | 3160 |
| (N20)NGG | 8 | 48733341 | - | CAATAAATGTCAGCAGGGACTGG | 1 | 5 | 56 | SEQ ID NO. | 3161 |
| (N20)NGG | 8 | 48733346 | - | TTTGTCAATAAATGTCAGCAGGG | 1 | 7 | 80 | SEQ ID NO. | 3162 |
| (N20)NGG | 8 | 48733347 | - | CTTTGTCAATAAATGTCAGCAGG | 1 | 6 | 51 | SEQ ID NO. | 3163 |
| (N20)NGG | 8 | 48733386 | - | GAAGCTCTAGAATCGCCTTCTGG | 1 | 1 | 14 | SEQ ID NO. | 3164 |
| (N20)NGG | 8 | 48733437 | - | TGTCAACATCATCTTGCAGGAGG | 1 | 3 | 37 | SEQ ID NO. | 3165 |
| (N20)NGG | 8 | 48733440 | - | CTCTGTCAACATCATCTTGCAGG | 1 | 6 | 41 | SEQ ID NO. | 3166 |
| (N20)NGG | 8 | 48733463 | - | GCCATTTTGAATGTAATATTTGG | 1 | 4 | 97 | SEQ ID NO. | 3167 |
| (N20)NGG | 8 | 48734164 | + | TTTTATTAACTTTTTCTCCACTAGG | 1 | 9 | 169 | SEQ ID NO. | 3168 |
| (N20)NGG | 8 | 48734184 | + | AGGCTCTCAATAAACAAGACTGG | 1 | 3 | 34 | SEQ ID NO. | 3169 |
| (N20)NGG | 8 | 48734185 | + | GGCTCTCAATAAACAAGACTGGG | 1 | 5 | 31 | SEQ ID NO. | 3170 |
| (N20)NGG | 8 | 48734192 | + | AATAAACAAGACTGGGTAGATGG | 1 | 5 | 73 | SEQ ID NO. | 3171 |
| (N20)NGG | 8 | 48734215 | + | TGAGCCCACAGAAGCCGAGAAGG | 1 | 5 | 67 | SEQ ID NO. | 3172 |
| (N20)NGG | 8 | 48734223 | + | CAGAAGCCGAGAAGGATTTTTGG | 1 | 3 | 40 | SEQ ID NO. | 3173 |
| (N20)NGG | 8 | 48734224 | + | AGAAGCCGAGAAGGATTTTTGGG | 1 | 2 | 44 | SEQ ID NO. | 3174 |
| (N20)NGG | 8 | 48734265 | + | GTTACAACCACCTTGCTGAGTGG | 2 | 3 | 22 | SEQ ID NO. | 3175 |
| (N20)NGG | 8 | 48734334 | + | CCCCAGACCTAAATAAAATCTGG | 1 | 2 | 38 | SEQ ID NO. | 3176 |

FIG. 12 cont.

| site_type | site_chr omosome | site_start_ nucleotide | site_s trand | target_site_sequence wi th NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 8 | 48734353 | + | CTGGAGTGAACCATTTTATCAGG | 1 | 1 | 5 | 41 SEQ ID NO. 3177 |
| (N20)NGG | 8 | 48734356 | + | GAGTGAACCATTTTATCAGGTGG | 1 | 1 | 2 | 42 SEQ ID NO. 3178 |
| (N20)NGG | 8 | 48734357 | + | AGTGAACCATTTTATCAGGTGGG | 1 | 1 | 3 | 42 SEQ ID NO. 3179 |
| (N20)NGG | 8 | 48734157 | - | CTTGTTTATTGAGAGCCTAGTGG | 1 | 1 | 2 | 39 SEQ ID NO. 3180 |
| (N20)NGG | 8 | 48734197 | - | AAATCCTTCTCGGCTTCTGTGGG | 1 | 1 | 2 | 29 SEQ ID NO. 3181 |
| (N20)NGG | 8 | 48734198 | - | AAAATCCTTCTCGGCTTCTGTGG | 1 | 1 | 1 | 39 SEQ ID NO. 3182 |
| (N20)NGG | 8 | 48734207 | - | AAGTTCCCAAAAATCCTTCTCGG | 1 | 1 | 4 | 67 SEQ ID NO. 3183 |
| (N20)NGG | 8 | 48734234 | - | AAGGTTGTTGTAACAGTCAAGGG | 1 | 1 | 3 | 29 SEQ ID NO. 3184 |
| (N20)NGG | 8 | 48734235 | - | AAGGTGGTTGTAACAGTCAAGG | 1 | 1 | 2 | 39 SEQ ID NO. 3185 |
| (N20)NGG | 8 | 48734250 | - | GTGATTTCCACTCAGCAAGGTGG | 1 | 1 | 2 | 36 SEQ ID NO. 3186 |
| (N20)NGG | 8 | 48734253 | - | CAAGTGCATTTCCACTCAGCAAGG | 1 | 1 | 2 | 36 SEQ ID NO. 3187 |
| (N20)NGG | 8 | 48734291 | - | GGGGTTCTCACTGTCTATACTGG | 1 | 1 | 1 | 24 SEQ ID NO. 3188 |
| (N20)NGG | 8 | 48734310 | - | AGATTTTATTTAGGTCTGGGGGG | 1 | 1 | 2 | 44 SEQ ID NO. 3189 |
| (N20)NGG | 8 | 48734311 | - | CAGATTTTATTTAGGTCTGGGGG | 2 | 2 | 3 | 58 SEQ ID NO. 3190 |
| (N20)NGG | 8 | 48734312 | - | CCAGATTTTATTTAGGTCTGGGG | 1 | 1 | 1 | 49 SEQ ID NO. 3191 |
| (N20)NGG | 8 | 48734313 | - | TCCAGATTTTATTTAGGTCTGGG | 1 | 1 | 3 | 83 SEQ ID NO. 3192 |
| (N20)NGG | 8 | 48734314 | - | CTCCAGATTTTATTTAGGTCTGG | 1 | 1 | 5 | 43 SEQ ID NO. 3193 |
| (N20)NGG | 8 | 48734319 | - | GTTCACTCCAGATTTTATTTAGG | 2 | 2 | 6 | 102 SEQ ID NO. 3194 |
| (N20)NGG | 8 | 48734341 | - | ATTTTACCACCTGATAAAATGG | 1 | 1 | 5 | 95 SEQ ID NO. 3195 |
| (N20)NGG | 8 | 48736418 | + | GCCTTTTTGATTGTTTTCTAGG | 1 | 1 | 19 | 440 SEQ ID NO. 3196 |
| (N20)NGG | 8 | 48736435 | + | TGTAGGCTGTATAGATCAATTGG | 1 | 1 | 2 | 24 SEQ ID NO. 3197 |
| (N20)NGG | 8 | 48736456 | + | GGAGAATACGACGTCCTCCGTGG | 1 | 1 | 1 | 3 SEQ ID NO. 3198 |
| (N20)NGG | 8 | 48736457 | + | GAGAATACGACGTCCTCCGTGGG | 1 | 1 | 1 | 2 SEQ ID NO. 3199 |
| (N20)NGG | 8 | 48736477 | + | GGGATTTTTACCAGTGAGATAGG | 1 | 1 | 5 | 46 SEQ ID NO. 3200 |
| (N20)NGG | 8 | 48736557 | + | AGCTCGTAAGCAGTATGATGAGG | 1 | 1 | 3 | 41 SEQ ID NO. 3201 |
| (N20)NGG | 8 | 48736573 | + | GATGAGGTAAAATTGATCTCTGG | 1 | 1 | 2 | 48 SEQ ID NO. 3202 |
| (N20)NGG | 8 | 48736397 | - | GCCTACAAAACAAATCAAAAAGG | 1 | 1 | 12 | 260 SEQ ID NO. 3203 |
| (N20)NGG | 8 | 48736448 | - | CACTGGTAAAAATCCCACGAGG | 1 | 1 | 2 | 19 SEQ ID NO. 3204 |
| (N20)NGG | 8 | 48736451 | - | TCTCACTGGTAAAAATCCCACGG | 1 | 1 | 7 | 62 SEQ ID NO. 3205 |
| (N20)NGG | 8 | 48736465 | - | TTGCTTTGTTCCTATCTCACTGG | 2 | 2 | 3 | 79 SEQ ID NO. 3206 |
| (N20)NGG | 8 | 48736516 | - | AGCTTCAGAATAATCACTTCTGG | 1 | 1 | 3 | 60 SEQ ID NO. 3207 |
| (N20)NGG | 8 | 48739216 | + | GGTTGTATGTGTGGTTTCACAGG | 1 | 1 | 2 | 41 SEQ ID NO. 3208 |
| (N20)NGG | 8 | 48739261 | + | CCTGCTGAGCCTCGACCCAGCGG | 1 | 1 | 2 | 42 SEQ ID NO. 3209 |

FIG. 12 cont.

| site_type | site_chr omosome | site_start_ nucleotide | site_s trand | target_site_sequence_wi th_NGG | genome_wide_ hits_with_1 or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 8 | 48739274 | + | GACCCAGCGCTGTTAGCGCTGG | | 1 | 3 | SEQ ID NO. 3210 |
| (N20)NGG | 8 | 48739282 | + | GGCTGTTAGCGCTGGTTGCCTGG | 1 | 1 | 6 | SEQ ID NO. 3211 |
| (N20)NGG | 8 | 48739303 | + | GGCAGCCTACAGCAGCCCGTGG | 1 | 2 | 30 | SEQ ID NO. 3212 |
| (N20)NGG | 8 | 48739304 | + | GCCAGCCTACAGCAGCCCGTGGG | 1 | 2 | 17 | SEQ ID NO. 3213 |
| (N20)NGG | 8 | 48739321 | + | CGTGGGCATCCGCCTGCTAGAGG | 1 | 6 | 20 | SEQ ID NO. 3214 |
| (N20)NGG | 8 | 48739324 | + | GGGCATCCGCCTGCTAGAGGAGG | 1 | 8 | 30 | SEQ ID NO. 3215 |
| (N20)NGG | 8 | 48739373 | + | CTGCCTGCCAAGCGAGTCCGTGG | 1 | 1 | 8 | SEQ ID NO. 3216 |
| (N20)NGG | 8 | 48739374 | + | TGCCTGCCAAGCGAGTCCGTGGG | 1 | 1 | 5 | SEQ ID NO. 3217 |
| (N20)NGG | 8 | 48739378 | + | TGCCAAGCGAGTCCGTGGGAAGG | 1 | 1 | 9 | SEQ ID NO. 3218 |
| (N20)NGG | 8 | 48739407 | + | TCCCTCCTGATGTCCTCAGATGG | 1 | 2 | 55 | SEQ ID NO. 3219 |
| (N20)NGG | 8 | 48739408 | + | CCCTCCTGATGTCCTCAGATGGG | 1 | 3 | 39 | SEQ ID NO. 3220 |
| (N20)NGG | 8 | 48739411 | + | TCCTGATGTCCTCAGATGGGTGG | 1 | 5 | 46 | SEQ ID NO. 3221 |
| (N20)NGG | 8 | 48739433 | + | GAGCTTGCTAAGTAAGTGTGAGG | 1 | 6 | 26 | SEQ ID NO. 3222 |
| (N20)NGG | 8 | 48739438 | + | TGCTAAGTAAGTGTGAGGTCAGG | 1 | 1 | 35 | SEQ ID NO. 3223 |
| (N20)NGG | 8 | 48739238 | - | CGCTGGGTCGAGGCTCAGCAGGG | 1 | 1 | 26 | SEQ ID NO. 3224 |
| (N20)NGG | 8 | 48739239 | - | CCGCTGGGTCGAGGCTCAGCAGG | 1 | 1 | 17 | SEQ ID NO. 3225 |
| (N20)NGG | 8 | 48739248 | - | CGCTAACAGCGCTGGGCTCGAGG | 1 | 1 | 2 | SEQ ID NO. 3226 |
| (N20)NGG | 8 | 48739254 | - | AACCAGCGCTAACAGCCGCTGGG | 1 | 2 | 4 | SEQ ID NO. 3227 |
| (N20)NGG | 8 | 48739255 | - | CAACAGCGCTAACAGCCGCTGG | 1 | 2 | 4 | SEQ ID NO. 3228 |
| (N20)NGG | 8 | 48739278 | - | CGGGCTGCTGTAGGCTGGCAGG | 1 | 1 | 26 | SEQ ID NO. 3229 |
| (N20)NGG | 8 | 48739283 | - | GCCCACGGGCTGCTGTAGGCTGG | 1 | 2 | 25 | SEQ ID NO. 3230 |
| (N20)NGG | 8 | 48739287 | - | GGATGCCCACGGGCTGCTGTAGG | 1 | 2 | 38 | SEQ ID NO. 3231 |
| (N20)NGG | 8 | 48739297 | - | TCTAGCAGGCGATGCCCACGGG | 1 | 3 | 28 | SEQ ID NO. 3232 |
| (N20)NGG | 8 | 48739298 | - | CTCTAGCAGGCGATGCCCACGG | 1 | 7 | 13 | SEQ ID NO. 3233 |
| (N20)NGG | 8 | 48739308 | - | GCAGAGCCTCCTCTAGCAGGCGG | 1 | 5 | 72 | SEQ ID NO. 3234 |
| (N20)NGG | 8 | 48739311 | - | GCAGCAGAGCCTCCTCTAGCAGG | 1 | 4 | 43 | SEQ ID NO. 3235 |
| (N20)NGG | 8 | 48739332 | - | GCAGCTCAGCAGGCAGCAGGCGG | 2 | 14 | 212 | SEQ ID NO. 3236 |
| (N20)NGG | 8 | 48739335 | - | CAGGCAGCTCAGCAGGCAGCAGG | 2 | 28 | 218 | SEQ ID NO. 3237 |
| (N20)NGG | 8 | 48739342 | - | CGCTTGGCAGGCAGCTCAGCAGG | 2 | 5 | 47 | SEQ ID NO. 3238 |
| (N20)NGG | 8 | 48739354 | - | TTCCCACGGACTGCTTGGCAGG | 1 | 1 | 7 | SEQ ID NO. 3239 |
| (N20)NGG | 8 | 48739358 | - | GGCCTTCCCACGGACTGCTTGG | 1 | 2 | 6 | SEQ ID NO. 3240 |
| (N20)NGG | 8 | 48739368 | - | GAGGGAGGCGGCCTTCCCACGG | 2 | 5 | 57 | SEQ ID NO. 3241 |
| (N20)NGG | 8 | 48739379 | - | GAGGACATCAGGAGGAGGCGG | 1 | 7 | 124 | SEQ ID NO. 3242 |

FIG. 12 cont.

| site_type | site_chr omosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48739380 | - | TGAGGACATCAGGAGGGAGGCGG | 2 | 17 | 168 | SEQ ID NO. 3243 |
| (N20)NGG | 8 | 48739383 | - | ATCTGAGGACATCAGGAGGGAGG | 1 | 3 | 71 | SEQ ID NO. 3244 |
| (N20)NGG | 8 | 48739386 | - | CCCATCTGAGGACATCAGGAGGG | 1 | 2 | 52 | SEQ ID NO. 3245 |
| (N20)NGG | 8 | 48739387 | - | ACCCATCTGAGGACATCAGGAGG | 1 | 1 | 33 | SEQ ID NO. 3246 |
| (N20)NGG | 8 | 48739390 | - | TCCACCCATCTGAGGACATCAGG | 1 | 1 | 35 | SEQ ID NO. 3247 |
| (N20)NGG | 8 | 48739398 | - | TAGCAAGCTCCACCCATCTGAGG | 1 | 2 | 24 | SEQ ID NO. 3248 |
| (N20)NGG | 8 | 48740730 | + | TTGTTTTGAATTTTTTACAGAGG | 1 | 38 | 467 | SEQ ID NO. 3249 |
| (N20)NGG | 8 | 48740731 | + | TGTTTTGAATTTTTTACAGAGGG | 3 | 24 | 669 | SEQ ID NO. 3250 |
| (N20)NGG | 8 | 48740774 | + | CTCTTTAGCAGCTTGTTTTCTGG | 1 | 6 | 55 | SEQ ID NO. 3251 |
| (N20)NGG | 8 | 48740791 | + | TTCTGGAATTTTGAAAGAGATGG | 3 | 15 | 244 | SEQ ID NO. 3252 |
| (N20)NGG | 8 | 48740908 | + | ACCCTTTGTCTCTTGTATTCAGG | 1 | 3 | 89 | SEQ ID NO. 3253 |
| (N20)NGG | 8 | 48740733 | - | AGAGCTGTTTTGCAATTATTGGG | 2 | 4 | 87 | SEQ ID NO. 3254 |
| (N20)NGG | 8 | 48740737 | - | AAGAGCTGTTTTGCAATTATTGG | 1 | 5 | 73 | SEQ ID NO. 3255 |
| (N20)NGG | 8 | 48740867 | - | GGGTGGAAAGAAAGAGAAGGTGG | 6 | 51 | 772 | SEQ ID NO. 3256 |
| (N20)NGG | 8 | 48740870 | - | AAAGGGTGGAAAGAAAGAGAAGG | 4 | 94 | 1695 | SEQ ID NO. 3257 |
| (N20)NGG | 8 | 48740884 | - | TGAATACAAGAGACAAAGGGTGG | 1 | 5 | 118 | SEQ ID NO. 3258 |
| (N20)NGG | 8 | 48740887 | - | ACCTGAATACAAGAGACAAAGGG | 1 | 2 | 67 | SEQ ID NO. 3259 |
| (N20)NGG | 8 | 48740888 | - | TACCTGAATACAAGAGACAAAGG | 1 | 6 | 51 | SEQ ID NO. 3260 |
| (N20)NGG | 8 | 48743165 | + | TCTTTGGTTCTGGTGCTTATAGG | 1 | 2 | 51 | SEQ ID NO. 3261 |
| (N20)NGG | 8 | 48743195 | + | GAGTGAGTTAAAAATGAAGCAGG | 1 | 4 | 76 | SEQ ID NO. 3262 |
| (N20)NGG | 8 | 48743204 | + | AAAAATGAAGCAGGATGCCCAGG | 1 | 3 | 93 | SEQ ID NO. 3263 |
| (N20)NGG | 8 | 48743227 | + | TCGTTCTGTACAGAAGCTACCGG | 1 | 1 | 13 | SEQ ID NO. 3264 |
| (N20)NGG | 8 | 48743232 | + | CTGTACAGAAGCTACCGGCACGG | 1 | 3 | 14 | SEQ ID NO. 3265 |
| (N20)NGG | 8 | 48743285 | + | CAGCCTCATCACCCCGTTACAGG | 1 | 2 | 18 | SEQ ID NO. 3266 |
| (N20)NGG | 8 | 48743291 | + | CATCACCCCGTTACAGGCCGTGG | 1 | 1 | 28 | SEQ ID NO. 3267 |
| (N20)NGG | 8 | 48743297 | + | CCCGTTACAGGCCGTGGCCCAGG | 1 | 1 | 5 | SEQ ID NO. 3268 |
| (N20)NGG | 8 | 48743199 | - | GCTTCTGTACAGAACGACCTGGG | 1 | 1 | 19 | SEQ ID NO. 3269 |
| (N20)NGG | 8 | 48743200 | - | AGCTTCTGTACAGAACGACCTGG | 1 | 1 | 7 | SEQ ID NO. 3270 |
| (N20)NGG | 8 | 48743224 | - | TGTTCAGGAAGGTCTCCGTGCGG | 1 | 3 | 23 | SEQ ID NO. 3271 |
| (N20)NGG | 8 | 48743236 | - | GCTTGATCTGAATGTCAGGAAGG | 1 | 5 | 42 | SEQ ID NO. 3272 |
| (N20)NGG | 8 | 48743240 | - | CTGTGCTTGATCTGAATGTCAGG | 1 | 2 | 28 | SEQ ID NO. 3273 |
| (N20)NGG | 8 | 48743266 | - | CGGCCTGTAACGGGGTGATGAGG | 1 | 1 | 7 | SEQ ID NO. 3274 |
| (N20)NGG | 8 | 48743274 | - | CTGGGCCACGGCCTGTAACGGGG | 1 | 1 | 8 | SEQ ID NO. 3275 |

FIG. 12 cont.

| site_type | site_chr omosome | site_start_ nucleotide | site_s trand | target_site_sequence_wi th NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 8 | 48743275 | - | CCTGGGCCACGGCCTGTAACGGG | | 1 | 31 | SEQ ID NO. 3276 |
| (N20)NGG | 8 | 48743276 | - | ACCTGGGCCACGGCCTGTAACGG | | 2 | 11 | SEQ ID NO. 3277 |
| (N20)NGG | 8 | 48743286 | - | GCAAAAACTGACCTGGGCCACGG | | 3 | 40 | SEQ ID NO. 3278 |
| (N20)NGG | 8 | 48743292 | - | GCAGCGGCAAAAACTGACCTGGG | | 2 | 19 | SEQ ID NO. 3279 |
| (N20)NGG | 8 | 48743293 | - | CGCAGCGGCAAAAACTGACCTGG | | 1 | 12 | SEQ ID NO. 3280 |
| (N20)NGG | 8 | 48744374 | + | TGGCCTGCTTTCCCTCTCCAGG | | 8 | 68 | SEQ ID NO. 3281 |
| (N20)NGG | 8 | 48744379 | + | CTGCTTTCCCTCTCCAGGTGCGG | 2 | 12 | 111 | SEQ ID NO. 3282 |
| (N20)NGG | 8 | 48744383 | + | TTTCCCTCTCCAGGTGCGGCCGG | 1 | 2 | 30 | SEQ ID NO. 3283 |
| (N20)NGG | 8 | 48744387 | + | CCTCTCCAGGTGCGGCCGGCCGG | 1 | 3 | 25 | SEQ ID NO. 3284 |
| (N20)NGG | 8 | 48744391 | + | TCCAGGTGCGGCCGGCCGGACGG | 1 | 2 | 23 | SEQ ID NO. 3285 |
| (N20)NGG | 8 | 48744414 | + | ACCTACTACGACTGCGCAGACGG | 1 | 1 | 5 | SEQ ID NO. 3286 |
| (N20)NGG | 8 | 48744423 | + | GACTGCGCAGACGGTTTATGAGG | 1 | 1 | 3 | SEQ ID NO. 3287 |
| (N20)NGG | 8 | 48744424 | + | ACTGCGCAGACGGTTTATGAGGG | 1 | 1 | 2 | SEQ ID NO. 3288 |
| (N20)NGG | 8 | 48744430 | + | CAGACGGTTTATGAGGGACCAGG | 1 | 1 | 10 | SEQ ID NO. 3289 |
| (N20)NGG | 8 | 48744461 | + | AGTTTGATGTATGCCAGAAAAGG | 1 | 1 | 77 | SEQ ID NO. 3290 |
| (N20)NGG | 8 | 48744487 | + | TGCTGAGCAAAAACGAGAGAAGG | 1 | 4 | 56 | SEQ ID NO. 3291 |
| (N20)NGG | 8 | 48744356 | - | CGCACCTGAGAGGGAAAGCAGG | 1 | 3 | 41 | SEQ ID NO. 3292 |
| (N20)NGG | 8 | 48744364 | - | CGGCCAGCCGCCACCTGGAGAGG | 1 | 4 | 22 | SEQ ID NO. 3293 |
| (N20)NGG | 8 | 48744365 | - | CCGGCCAGCCGCCACCTGGAGAG | 1 | 3 | 35 | SEQ ID NO. 3294 |
| (N20)NGG | 8 | 48744370 | - | TCCGTCCGGCCAGCCGCCACCTGG | 1 | 2 | 25 | SEQ ID NO. 3295 |
| (N20)NGG | 8 | 48744380 | - | TCGTAGTAGTCCGTCCGGCCGG | 1 | 1 | 1 | SEQ ID NO. 3296 |
| (N20)NGG | 8 | 48744384 | - | GCAGTCGTAGTAGTCCGTCCGG | 1 | 1 | 1 | SEQ ID NO. 3297 |
| (N20)NGG | 8 | 48744393 | - | ACCGTCTGCGCCAGTCGTAGTAGG | 1 | 1 | 3 | SEQ ID NO. 3298 |
| (N20)NGG | 8 | 48744426 | - | ACATCAAACTGAGCTTCTCCTGG | 1 | 3 | 41 | SEQ ID NO. 3299 |
| (N20)NGG | 8 | 48744452 | - | TTGCTCAGCAACGCCTTTTCTGG | 1 | 2 | 26 | SEQ ID NO. 3300 |
| (N20)NGG | 8 | 48746759 | + | CTCTGATTGCATGTCACAGATGG | 1 | 2 | 46 | SEQ ID NO. 3301 |
| (N20)NGG | 8 | 48746778 | + | ATGGAAGAAGCTCATTTGATTGG | 1 | 2 | 51 | SEQ ID NO. 3302 |
| (N20)NGG | 8 | 48746786 | + | AGCTCATTTGATTGGCTGACCGG | 1 | 1 | 28 | SEQ ID NO. 3303 |
| (N20)NGG | 8 | 48746787 | + | GCTCATTTGATTGGCTGACCGGG | 1 | 1 | 13 | SEQ ID NO. 3304 |
| (N20)NGG | 8 | 48746806 | + | GCGGAGCAGCACTGACCCGCTGG | 2 | 2 | 18 | SEQ ID NO. 3305 |
| (N20)NGG | 8 | 48746856 | + | CCTTGCTGTTTGCCCACACAAGAGG | 1 | 4 | 45 | SEQ ID NO. 3306 |
| (N20)NGG | 8 | 48746865 | + | TTGCCACAAGAGGAGTGAAAGG | 1 | 3 | 47 | SEQ ID NO. 3307 |
| (N20)NGG | 8 | 48746893 | + | GAGAGCACCCTTGAAGTCAGTGG | 1 | 2 | 38 | SEQ ID NO. 3308 |

FIG. 12 cont.

| site type | site_chr omosome | site_start_ nucleotide | site_s trand | target_site_sequence_wi th_NGG | genome_wide_ hits_with_1 or_less_mism atches | genome_wide_ hits_with_ 2_or_less_m ismatches | genome_wide_ hits_with_3 or_less_mism atches | |
|---|---|---|---|---|---|---|---|---|
| (N20)NGG | 8 | 48746894 | + | AGAGCACCCTTGAAGTCAGTGGG | | 1 | 29 | SEQ ID NO. 3309 |
| (N20)NGG | 8 | 48746895 | + | GAGCACCCTTGAAGTCAGTGGGG | | 1 | 36 | SEQ ID NO. 3310 |
| (N20)NGG | 8 | 48746906 | + | AAGTCAGTGGGGCCTGATTTTGG | | 1 | 40 | SEQ ID NO. 3311 |
| (N20)NGG | 8 | 48746907 | + | AGTCAGTGGGGCCTGATTTTTGG | | 1 | 42 | SEQ ID NO. 3312 |
| (N20)NGG | 8 | 48746916 | + | GGCCTGATTTTGGGAAAAAAAGG | | 1 | 82 | SEQ ID NO. 3313 |
| (N20)NGG | 8 | 48746920 | + | TGATTTTGGGAAAAAAAGGCTGG | | 4 | 128 | SEQ ID NO. 3314 |
| (N20)NGG | 8 | 48746921 | + | GATTTTGGGAAAAAAAGGCTGGG | | 2 | 11 | 103 | SEQ ID NO. 3315 |
| (N20)NGG | 8 | 48746930 | + | AAAAAAGGCTGGGCCTTCCAGG | | 1 | 9 | 87 | SEQ ID NO. 3316 |
| (N20)NGG | 8 | 48746931 | + | AAAAAAGGCTGGGCCTTCCAGGG | | 1 | 6 | 46 | SEQ ID NO. 3317 |
| (N20)NGG | 8 | 48746932 | + | AAAAAGGCTGGGCCTTCCAGGGG | | 1 | 3 | 54 | SEQ ID NO. 3318 |
| (N20)NGG | 8 | 48746938 | + | GCTGGGCCTTCCAGGGGACGAGG | | 2 | 3 | 58 | SEQ ID NO. 3319 |
| (N20)NGG | 8 | 48746941 | + | GGGCCTTCCAGGGGACGAGGTGG | | 1 | 6 | 63 | SEQ ID NO. 3320 |
| (N20)NGG | 8 | 48746957 | + | GAGGTGGATAACAAAGTGAAAGG | | 1 | 5 | 104 | SEQ ID NO. 3321 |
| (N20)NGG | 8 | 48746965 | + | TAACAAAGTGAAAGGTAAGCTGG | | 1 | 3 | 64 | SEQ ID NO. 3322 |
| (N20)NGG | 8 | 48746966 | + | AACAAAGTGAAAGGTAAGCTGGG | | 1 | 7 | 103 | SEQ ID NO. 3323 |
| (N20)NGG | 8 | 48746734 | − | TCTGTGACATGCAATCAGAGAGG | | 1 | 8 | 56 | SEQ ID NO. 3324 |
| (N20)NGG | 8 | 48746783 | − | CAGCGGGTCAGTGCTGCTCCCGG | | 1 | 2 | 31 | SEQ ID NO. 3325 |
| (N20)NGG | 8 | 48746799 | − | GACTGGTGTGTGTCGACCAGCGG | | 1 | 3 | 5 | SEQ ID NO. 3326 |
| (N20)NGG | 8 | 48746800 | − | GGACTGGTGTGTCGACCAGCGG | | 1 | 1 | 11 | SEQ ID NO. 3327 |
| (N20)NGG | 8 | 48746811 | − | AGTCAGATGAGGGACTGGTGTGG | | 1 | 2 | 64 | SEQ ID NO. 3328 |
| (N20)NGG | 8 | 48746816 | − | CAAGGAGTCAGATGAGGGACTGG | | 2 | 4 | 50 | SEQ ID NO. 3329 |
| (N20)NGG | 8 | 48746821 | − | AACAGCAAGGAGTCAGATGAGGG | | 1 | 2 | 57 | SEQ ID NO. 3330 |
| (N20)NGG | 8 | 48746822 | − | AAACAGCAAGGAGTCAGATGAGG | | 2 | 5 | 103 | SEQ ID NO. 3331 |
| (N20)NGG | 8 | 48746834 | − | CCTCTTGTGTGGCAAACAGCAGG | | 1 | 5 | 45 | SEQ ID NO. 3332 |
| (N20)NGG | 8 | 48746846 | − | TAACCTTTCACTCCTCTTGTGGG | | 1 | 4 | 51 | SEQ ID NO. 3333 |
| (N20)NGG | 8 | 48746847 | − | GTAACCTTTCACTCCTCTTGTGG | | 1 | 1 | 20 | SEQ ID NO. 3334 |
| (N20)NGG | 8 | 48746878 | − | TCAGGCCCCACTGACTTCAAGGG | | 1 | 5 | 50 | SEQ ID NO. 3335 |
| (N20)NGG | 8 | 48746879 | − | ATCAGGCCCCACTGACTTCAAGG | | 1 | 3 | 47 | SEQ ID NO. 3336 |
| (N20)NGG | 8 | 48746896 | − | AGCCTTTTTTTCCCAAAATCAGG | | 1 | 6 | 84 | SEQ ID NO. 3337 |
| (N20)NGG | 8 | 48746922 | − | TATCCACCTCGTCCCCTGGAAGG | | 1 | 2 | 13 | SEQ ID NO. 3338 |
| (N20)NGG | 8 | 48746926 | − | TTGTTATCCACCTCGTCCCCTGG | | 1 | 1 | 18 | SEQ ID NO. 3339 |
| (N20)NGG | 8 | 48748898 | + | TTTGAAACTTTCTTATGTACAGG | | 1 | 5 | 95 | SEQ ID NO. 3340 |
| (N20)NGG | 8 | 48748921 | + | AATATACCATTGATTCTGATTGG | | 2 | 2 | 58 | SEQ ID NO. 3341 |

FIG. 12 cont.

| site_type | site_chr omosome | site_start_ nucleotide | site_s trand | target_site_sequence_wi th_NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 8 | 48748958 | + | TGTTCTCACTCCGATGTTTGTGG | 1 | 2 | 18 | SEQ ID NO. 3342 |
| (N20)NGG | 8 | 48748967 | + | TCCGATGTTTGTGAGACCCAGG | | 3 | 17 | SEQ ID NO. 3343 |
| (N20)NGG | 8 | 48748976 | + | TGTGGAGACCCAGGCCTCCCAGG | 1 | 11 | 71 | SEQ ID NO. 3344 |
| (N20)NGG | 8 | 48748977 | + | GTGGAGACCCAGGCCTCCCAGGG | 2 | 8 | 79 | SEQ ID NO. 3345 |
| (N20)NGG | 8 | 48749000 | + | CACTCTCCAGACCCGTACCCAGG | 1 | 3 | 19 | SEQ ID NO. 3346 |
| (N20)NGG | 8 | 48749004 | + | CTCCAGACCCGTACCCAGGAAGG | 1 | 2 | 27 | SEQ ID NO. 3347 |
| (N20)NGG | 8 | 48749005 | + | TCCAGACCCGTACCCAGGAAGGG | 1 | 2 | 41 | SEQ ID NO. 3348 |
| (N20)NGG | 8 | 48749023 | + | AAGGGTCCCTCTCAGCTCGCTGG | 1 | 3 | 26 | SEQ ID NO. 3349 |
| (N20)NGG | 8 | 48749030 | + | CCTCTCAGCTCGCTGGCCAGTGG | 1 | 3 | 38 | SEQ ID NO. 3350 |
| (N20)NGG | 8 | 48749034 | + | TCAGCTCGCTGGCCAGTGGCAGG | 1 | 3 | 26 | SEQ ID NO. 3351 |
| (N20)NGG | 8 | 48749035 | + | CAGCTCGCTGGCCAGTGGCAGGG | 2 | 10 | 62 | SEQ ID NO. 3352 |
| (N20)NGG | 8 | 48749044 | + | GGCCAGTGGCAGGGCAGATAAGG | 1 | 6 | 71 | SEQ ID NO. 3353 |
| (N20)NGG | 8 | 48749045 | + | GCCAGTGGCAGGGCAGATAAGGG | 1 | 7 | 75 | SEQ ID NO. 3354 |
| (N20)NGG | 8 | 48749088 | + | TTCACACTGACACAGACTGCAGG | 2 | 2 | 53 | SEQ ID NO. 3355 |
| (N20)NGG | 8 | 48749110 | + | GTAACAGTGACCCTGCCCGCTGG | 1 | 1 | 13 | SEQ ID NO. 3356 |
| (N20)NGG | 8 | 48748905 | - | GAAACGCCAATGACAGAATCAATGG | 1 | 2 | 35 | SEQ ID NO. 3357 |
| (N20)NGG | 8 | 48748927 | - | TCGGAGTGAGAACAGTACTTCGG | 1 | 3 | 19 | SEQ ID NO. 3358 |
| (N20)NGG | 8 | 48748946 | - | GCCTGGGTCTCCACAAACATCGG | 2 | 4 | 55 | SEQ ID NO. 3359 |
| (N20)NGG | 8 | 48748962 | - | GAGAGTGCCCTGGGAGGCCTGG | 1 | 6 | 76 | SEQ ID NO. 3360 |
| (N20)NGG | 8 | 48748963 | - | GGAGAGTGCCCTGGGAGGCCTGG | 1 | 13 | 140 | SEQ ID NO. 3361 |
| (N20)NGG | 8 | 48748968 | - | GGTCTGGAGAGTGCCCTGGGAGG | 1 | 5 | 107 | SEQ ID NO. 3362 |
| (N20)NGG | 8 | 48748971 | - | ACGGGTCTGGAGAGTGCCCTGGG | 1 | 1 | 22 | SEQ ID NO. 3363 |
| (N20)NGG | 8 | 48748972 | - | TACGGGTCTGGAGAGTGCCCTGG | 1 | 1 | 12 | SEQ ID NO. 3364 |
| (N20)NGG | 8 | 48748984 | - | ACCCTTCCTGGGTACGGGTCTGG | 1 | 1 | 17 | SEQ ID NO. 3365 |
| (N20)NGG | 8 | 48748989 | - | GAGGGACCCTTCCTGGGTACGG | 1 | 3 | 35 | SEQ ID NO. 3366 |
| (N20)NGG | 8 | 48748990 | - | AGAGGGACCCTTCCTGGGTACGG | 1 | 3 | 41 | SEQ ID NO. 3367 |
| (N20)NGG | 8 | 48748995 | - | AGCTGAGAGGGACCCTTCCTGGG | 1 | 4 | 47 | SEQ ID NO. 3368 |
| (N20)NGG | 8 | 48748996 | - | GAGCTGAGAGGGACCCTTCCTGG | 1 | 6 | 49 | SEQ ID NO. 3369 |
| (N20)NGG | 8 | 48749007 | - | CACTGGCCAGCGAGCTGAGAGGG | 1 | 5 | 25 | SEQ ID NO. 3370 |
| (N20)NGG | 8 | 48749008 | - | CCACTGGCCAGCGAGCTGAGAGG | 1 | 2 | 38 | SEQ ID NO. 3371 |
| (N20)NGG | 8 | 48749024 | - | GCCCTTATCTGCCCTGCCACTGG | 1 | 3 | 44 | SEQ ID NO. 3372 |
| (N20)NGG | 8 | 48749046 | - | GAAGTCATGCTGCTGCTGGGTTGG | 1 | 9 | 71 | SEQ ID NO. 3373 |
| (N20)NGG | 8 | 48749049 | - | TGTGAAGTCATGCTGCTGCTGGG | 1 | 2 | 53 | SEQ ID NO. 3374 |

FIG. 12 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48749050 | - | GTGTGAAGTCATGCTGCTGCTGG | | 1 | 3 | 34 SEQ ID NO. 3375 |
| (N20)NGG | 8 | 48749793 | + | GATTAATTATTCGAAATTTCTGG | | 1 | 2 | 34 SEQ ID NO. 3376 |
| (N20)NGG | 8 | 48749808 | + | ATTTCTGGAGCATGAAACTAGG | | 1 | 5 | 94 SEQ ID NO. 3377 |
| (N20)NGG | 8 | 48749827 | + | TAGGTTACCTTCAAATACCTTGG | | 1 | 1 | 22 SEQ ID NO. 3378 |
| (N20)NGG | 8 | 48749832 | + | TACCTTCAAATACCTTGGACCGG | | 1 | 1 | 27 SEQ ID NO. 3379 |
| (N20)NGG | 8 | 48749839 | + | AAATACCTTGGACCGGTTGCTGG | | 1 | 1 | 6 SEQ ID NO. 3380 |
| (N20)NGG | 8 | 48749980 | + | TCTGTCAGAATGCGAATTTCAGG | | 1 | 1 | 22 SEQ ID NO. 3381 |
| (N20)NGG | 8 | 48749988 | + | AATGCGAATTTCAGGTAATGTGG | | 1 | 5 | 40 SEQ ID NO. 3382 |
| (N20)NGG | 8 | 48749796 | - | TTGAAGGTAACCTAGTTTCATGG | | 1 | 3 | 31 SEQ ID NO. 3383 |
| (N20)NGG | 8 | 48749812 | - | AACCGGTCCAAGGTATTTGAAGG | | 1 | 1 | 6 SEQ ID NO. 3384 |
| (N20)NGG | 8 | 48749822 | - | TAGTGCCAAGCAACCGGTCCAAGG | | 1 | 1 | 10 SEQ ID NO. 3385 |
| (N20)NGG | 8 | 48749829 | - | AGGAATTTAGTGCCAGCAACCGG | | 1 | 5 | 51 SEQ ID NO. 3386 |
| (N20)NGG | 8 | 48749849 | - | TTCTATCTTAGGAGAATATAAGG | | 1 | 5 | 95 SEQ ID NO. 3387 |
| (N20)NGG | 8 | 48749860 | - | AAAAAGTGCACTTCTATCTTAGG | | 1 | 4 | 72 SEQ ID NO. 3388 |
| (N20)NGG | 8 | 48749915 | - | TGGATAATCTGGGCTCATGCTGG | | 1 | 2 | 12 SEQ ID NO. 3389 |
| (N20)NGG | 8 | 48749925 | - | ACATGGGGTTTGATAATCTGG | | 2 | 2 | 30 SEQ ID NO. 3390 |
| (N20)NGG | 8 | 48749926 | - | AACATGGGGTTTGATAATCTGG | | 1 | 4 | 28 SEQ ID NO. 3391 |
| (N20)NGG | 8 | 48749935 | - | GGATGCTCGAACATGGGGTTTGG | | 1 | 3 | 14 SEQ ID NO. 3392 |
| (N20)NGG | 8 | 48749940 | - | ACAGAGGATGCTCGAACATGGGG | | 1 | 1 | 18 SEQ ID NO. 3393 |
| (N20)NGG | 8 | 48749941 | - | GACAGAGGATGCTCGAACATGG | | 1 | 2 | 6 SEQ ID NO. 3394 |
| (N20)NGG | 8 | 48749942 | - | TGACAGAGGATGCTCGAACATGG | | 1 | 2 | 14 SEQ ID NO. 3395 |
| (N20)NGG | 8 | 48749956 | - | TGAAATTCGCATTCTGACAGAGG | | 1 | 2 | 25 SEQ ID NO. 3396 |
| (N20)NGG | 8 | 48751742 | + | TGAGACAGATAATGACTCCCAGG | | 1 | 4 | 36 SEQ ID NO. 3397 |
| (N20)NGG | 8 | 48751757 | + | CTCCAGGAAATATTTAAGTTGG | | 1 | 4 | 69 SEQ ID NO. 3398 |
| (N20)NGG | 8 | 48751779 | + | GCAAAGATGTGCTGATTCAAGG | | 1 | 1 | 50 SEQ ID NO. 3399 |
| (N20)NGG | 8 | 48751800 | + | GGATTGATCGATGAGAACCCTGG | | 1 | 1 | 5 SEQ ID NO. 3400 |
| (N20)NGG | 8 | 48751822 | + | GACTTCAGTACGTGAATAACTGG | | 1 | 4 | 17 SEQ ID NO. 3401 |
| (N20)NGG | 8 | 48751823 | + | ACTTCAGTACGTGAATAACTGGG | | 1 | 2 | 16 SEQ ID NO. 3402 |
| (N20)NGG | 8 | 48751827 | + | CAGTACGTGAATAACTGGGCTGG | | 1 | 1 | 6 SEQ ID NO. 3403 |
| (N20)NGG | 8 | 48751828 | + | AGTACGTGAATAACTGGGCTGG | | 1 | 1 | 14 SEQ ID NO. 3404 |
| (N20)NGG | 8 | 48751712 | - | TCATTATCTGTCTCACTTTCTGG | | 1 | 29 | 133 SEQ ID NO. 3405 |
| (N20)NGG | 8 | 48751737 | - | TGCCAACTTAAATATTTCCTGG | | 1 | 2 | 82 SEQ ID NO. 3406 |
| (N20)NGG | 8 | 48751738 | - | TTGCCAACTTAAATATTTCCTGG | | 1 | 6 | 76 SEQ ID NO. 3407 |

FIG. 12 cont.

| site_type | site_chr omosome | site_start_ nucleotide | site_s trand | target_site_sequence_wi th_NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 8 | 48751795 | - | TATTCACGTACTGAAGTCCAGGG | | 1 | 16 | SEQ ID NO. 3408 |
| (N20)NGG | 8 | 48751796 | - | TTATTCACGTACTGAAGTCCAGG | | 1 | 14 | SEQ ID NO. 3409 |
| (N20)NGG | 8 | 48752604 | + | TGAAAGACAAAAAGTATGTTTGG | | 2 | 184 | SEQ ID NO. 3410 |
| (N20)NGG | 8 | 48752673 | + | AGAACTTCTGAACCCGTTGTGG | 1 | | 15 | SEQ ID NO. 3411 |
| (N20)NGG | 8 | 48752705 | + | CCCATCCTTCTACAACATGTAGG | | 3 | 24 | SEQ ID NO. 3412 |
| (N20)NGG | 8 | 48752706 | + | CCATCCTTCTACAACATGTAGGG | | 2 | 28 | SEQ ID NO. 3413 |
| (N20)NGG | 8 | 48752732 | + | AAATGTATAATATTCTCATGTGG | | 2 | 185 | SEQ ID NO. 3414 |
| (N20)NGG | 8 | 48752750 | + | TGTGGATTCATGATAATTACAGG | 1 | | 31 | SEQ ID NO. 3415 |
| (N20)NGG | 8 | 48752569 | - | TTGTCTTTCATCATCTCTATGGG | | 2 | 7 | SEQ ID NO. 3416 |
| (N20)NGG | 8 | 48752570 | - | TTTGTCTTTCATCATCTCTATGG | 3 | | 124 | SEQ ID NO. 3417 |
| (N20)NGG | 8 | 48752625 | - | AGTTCTACTGGTTTTAACTTTGG | 1 | | 151 | SEQ ID NO. 3418 |
| (N20)NGG | 8 | 48752637 | - | AGAAGTTCTCGGAGTTCTACTGG | 1 | | 62 | SEQ ID NO. 3419 |
| (N20)NGG | 8 | 48752648 | - | CAACGGGTTCAGAAGTTCTCGG | | 3 | 26 | SEQ ID NO. 3420 |
| (N20)NGG | 8 | 48752663 | - | GGGAAACGAATTCCACAACGGGG | 1 | | 11 | SEQ ID NO. 3421 |
| (N20)NGG | 8 | 48752664 | - | TGGGAAACGAATTCCACAACGGG | 1 | | 7 | SEQ ID NO. 3422 |
| (N20)NGG | 8 | 48752665 | - | ATGGGAAACGAATTCCACAACGG | 1 | | 20 | SEQ ID NO. 3423 |
| (N20)NGG | 8 | 48752683 | - | CCTACACATGTTGTAGAAGGATGG | 1 | | 25 | SEQ ID NO. 3424 |
| (N20)NGG | 8 | 48752684 | - | CCCTACACATGTTGTAGAAGGATG | 1 | | 28 | SEQ ID NO. 3425 |
| (N20)NGG | 8 | 48752688 | - | TGTTCCCTACACATGTTGTAGAAGG | 1 | | 39 | SEQ ID NO. 3426 |
| (N20)NGG | 8 | 48761714 | + | CACCAGTTCCCTTCCCGCCAGG | 1 | | 34 | SEQ ID NO. 3427 |
| (N20)NGG | 8 | 48761755 | + | TTTCTGCTGCCAAAATTTCATGG | 1 | | 48 | SEQ ID NO. 3428 |
| (N20)NGG | 8 | 48761778 | + | AGTGTTGAAAACACTCTGTCTGG | 1 | | 114 | SEQ ID NO. 3429 |
| (N20)NGG | 8 | 48761781 | + | GTTGAAAACACTCTGTCTGGAGG | 1 | | 35 | SEQ ID NO. 3430 |
| (N20)NGG | 8 | 48761784 | + | GAAAACACTCTGTCTGGAGGTGG | 1 | | 93 | SEQ ID NO. 3431 |
| (N20)NGG | 8 | 48761799 | + | GGAGGTGGTACTTTGTCGTGTGG | 1 | | 68 | SEQ ID NO. 3432 |
| (N20)NGG | 8 | 48761802 | + | GGTGGTACTTTGTCGTGTGGAGG | 1 | | 25 | SEQ ID NO. 3433 |
| (N20)NGG | 8 | 48761803 | + | GTGGTACTTTGTCGTGTGGAGGG | 1 | | 8 | SEQ ID NO. 3434 |
| (N20)NGG | 8 | 48761838 | + | GTACTTCCAGTTAAAGAGCAAGG | 1 | | 16 | SEQ ID NO. 3435 |
| (N20)NGG | 8 | 48761864 | + | TCGTTCAAGTCATGAGACATAGG | 1 | | 77 | SEQ ID NO. 3436 |
| (N20)NGG | 8 | 48761694 | - | AACCTGCGGGAAGGGAACTGG | | 3 | 20 | SEQ ID NO. 3437 |
| (N20)NGG | 8 | 48761700 | - | TTCATGAACCTGCGGGGAAGGG | | 4 | 36 | SEQ ID NO. 3438 |
| (N20)NGG | 8 | 48761701 | - | ATTCATGAACCTGCGCGGGAAGG | | 2 | 28 | SEQ ID NO. 3439 |
| (N20)NGG | 8 | 48761705 | - | CAGCATTCATGAACCTGGCGGGG | | 2 | 36 | SEQ ID NO. 3440 |

FIG. 12 cont.

| site_type | site_chr omosome | site_start_ nucleotide | site_s trand | target_site_sequence_with NGG | genome_wide hits_with_1_ or_less_mism atches | genome_wide hits_with_ 2_or_less_m ismatches | genome_wide hits_with_ 3_or_less_mism atches | |
|---|---|---|---|---|---|---|---|---|
| (N20)NGG | 8 | 48761706 | - | ACAGCATTCATGAACCTGCGGG | 1 | | 50 | SEQ ID NO. 3441 |
| (N20)NGG | 8 | 48761707 | - | CACAGCATTCATGAACCTGCGG | 2 | 15 | 179 | SEQ ID NO. 3442 |
| (N20)NGG | 8 | 48761710 | - | GAACACAGCATTCATGAACCTGG | 1 | 7 | 49 | SEQ ID NO. 3443 |
| (N20)NGG | 8 | 48761742 | - | TTCAACACTCCATGAAATTTTGG | | 2 | 60 | SEQ ID NO. 3444 |
| (N20)NGG | 8 | 48761822 | - | CGAAGTCCTTGCTCTTTAACTGG | 2 | 3 | 19 | SEQ ID NO. 3445 |
| (N20)NGG | 8 | 48761945 | + | AAACTTAATTTTCAGATACTGG | | 12 | 154 | SEQ ID NO. 3446 |
| (N20)NGG | 8 | 48761948 | + | CTTAATTTTCAGATACTGGAGG | 1 | 2 | 75 | SEQ ID NO. 3447 |
| (N20)NGG | 8 | 48761966 | + | GGAGGAGTCTCTGTGTGAACTGG | 1 | 3 | 99 | SEQ ID NO. 3448 |
| (N20)NGG | 8 | 48762002 | + | GAAGCAACATCAGAATACTATGG | 1 | 1 | 45 | SEQ ID NO. 3449 |
| (N20)NGG | 8 | 48762005 | + | GCAACATCAGAATACTATGAGG | 1 | 3 | 34 | SEQ ID NO. 3450 |
| (N20)NGG | 8 | 48762064 | + | GCTTCCCTCCTCTTGCAGACAGG | 1 | 4 | 48 | SEQ ID NO. 3451 |
| (N20)NGG | 8 | 48762069 | + | CCTCCTCTTGCAGACAGGTATGG | 1 | 2 | 33 | SEQ ID NO. 3452 |
| (N20)NGG | 8 | 48762070 | + | CTCCTCTTGCAGACAGGTATGGG | 1 | 2 | 21 | SEQ ID NO. 3453 |
| (N20)NGG | 8 | 48762079 | + | CAGACAGGTATGGGCTGTCCAGG | 1 | 2 | 36 | SEQ ID NO. 3454 |
| (N20)NGG | 8 | 48762080 | + | AGACAGGTATGGGCTGTCCAGGG | 1 | 2 | 32 | SEQ ID NO. 3455 |
| (N20)NGG | 8 | 48762036 | - | TGCAAGAGGAGGGAAGCTCTTGG | 1 | 6 | 49 | SEQ ID NO. 3456 |
| (N20)NGG | 8 | 48762046 | - | CATACCTGTCTGCAAGAGGAGGG | 1 | 3 | 29 | SEQ ID NO. 3457 |
| (N20)NGG | 8 | 48762047 | - | CCATACCTGTCTGCAAGAGGAGG | 1 | 2 | 40 | SEQ ID NO. 3458 |
| (N20)NGG | 8 | 48762050 | - | AGCCCATACCTGTCTGCAAGAGG | 1 | 2 | 25 | SEQ ID NO. 3459 |
| (N20)NGG | 8 | 48765243 | + | TGTTTATTGTAGATACTTCCAGG | 1 | 14 | 73 | SEQ ID NO. 3460 |
| (N20)NGG | 8 | 48765249 | + | TTGTAGATACTTCCAGGCTTTGG | 1 | 2 | 27 | SEQ ID NO. 3461 |
| (N20)NGG | 8 | 48765310 | + | GCCGCTGCAGCAGAAGTTCTAGG | 1 | 2 | 25 | SEQ ID NO. 3462 |
| (N20)NGG | 8 | 48765333 | + | ACTTATACTTCGATATGTTATGG | 1 | 2 | 23 | SEQ ID NO. 3463 |
| (N20)NGG | 8 | 48765239 | - | ACATATTATTCACCAAAGCCTGG | 3 | 3 | 54 | SEQ ID NO. 3464 |
| (N20)NGG | 8 | 48765262 | - | CACTTCTTTATATCTTACAAAGG | 1 | 3 | 83 | SEQ ID NO. 3465 |
| (N20)NGG | 8 | 48765289 | - | TCCTAGAACTTCTGCTGCAGCGG | 1 | 4 | 71 | SEQ ID NO. 3466 |
| (N20)NGG | 8 | 48766643 | + | CTCCTTTGTGCTTATGTTTCAGG | 3 | 8 | 74 | SEQ ID NO. 3467 |
| (N20)NGG | 8 | 48766666 | + | TTAATATTTGAAAAGTTTTCCGG | 3 | 30 | 414 | SEQ ID NO. 3468 |
| (N20)NGG | 8 | 48766699 | + | AATTCTAAAGACAACTCAGTAGG | 1 | 7 | 92 | SEQ ID NO. 3469 |
| (N20)NGG | 8 | 48766700 | + | ATTCTAAAGACAACTCAGTAGGG | 1 | 6 | 74 | SEQ ID NO. 3470 |
| (N20)NGG | 8 | 48766714 | + | TCAGTAGGGATTCAATTGCTAGG | 1 | 2 | 25 | SEQ ID NO. 3471 |
| (N20)NGG | 8 | 48766725 | + | TCAATTGCTAGCATCGTGATGG | 1 | 2 | 12 | SEQ ID NO. 3472 |
| (N20)NGG | 8 | 48766759 | + | CCTCCCTATGACCCACAGTGTGG | 1 | 5 | 40 | SEQ ID NO. 3473 |

FIG. 12 cont.

| site_type | site_chromosome | site_start_nucleotide | site_strand | target_site_sequence_with NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 8 | 48766623 | - | AACCTGAAACATAAGCACAAAGG | | 1 | 4 | 105 | SEQ ID NO. 3474 |
| (N20)NGG | 8 | 48766663 | - | TTTAGAATTAGGATCTTTACCGG | | 1 | 11 | 138 | SEQ ID NO. 3475 |
| (N20)NGG | 8 | 48766674 | - | ACTGAGTTGTCTTTAGAATTAGG | | 1 | 4 | 65 | SEQ ID NO. 3476 |
| (N20)NGG | 8 | 48766726 | - | GTCATAGGGAGGCAGGTCATTGG | | 1 | 1 | 30 | SEQ ID NO. 3477 |
| (N20)NGG | 8 | 48766733 | - | ACTGTGGGTCATAGGGAGGCAGG | | 1 | 1 | 47 | SEQ ID NO. 3478 |
| (N20)NGG | 8 | 48766737 | - | CCACACTGTGGGTCATAGGGAGG | | 1 | 5 | 35 | SEQ ID NO. 3479 |
| (N20)NGG | 8 | 48766740 | - | ATGCCACACTGTGGGTCATAGG | | 1 | 7 | 33 | SEQ ID NO. 3480 |
| (N20)NGG | 8 | 48766741 | - | GATGCCACACTGTGGGTCATAGG | | 1 | 2 | 36 | SEQ ID NO. 3481 |
| (N20)NGG | 8 | 48766748 | - | TACTCTGGATGCCACACTGTGG | | 1 | 1 | 35 | SEQ ID NO. 3482 |
| (N20)NGG | 8 | 48766749 | - | CTACTCTGGATGCCACACTGTGG | | 1 | 2 | 41 | SEQ ID NO. 3483 |
| (N20)NGG | 8 | 48766763 | - | CAAACACGTACTCGCTACTCTGG | | 1 | 1 | 2 | SEQ ID NO. 3484 |
| (N20)NGG | 8 | 48767782 | + | CAGAATTTCTGTACCTTTTCAGGG | | 1 | 9 | 243 | SEQ ID NO. 3485 |
| (N20)NGG | 8 | 48767783 | + | AGAATTTCTGTACCTTTTCAGGG | | 1 | 8 | 278 | SEQ ID NO. 3486 |
| (N20)NGG | 8 | 48767784 | + | GAATTTCTGTACCTTTTCAGGGG | | 1 | 11 | 112 | SEQ ID NO. 3487 |
| (N20)NGG | 8 | 48767785 | + | AATTTCTGTACCTTTTCAGGGGG | | 1 | 9 | 110 | SEQ ID NO. 3488 |
| (N20)NGG | 8 | 48767907 | + | TAAAGACCCTGTCGAGTGCTGG | | 1 | 1 | 10 | SEQ ID NO. 3489 |
| (N20)NGG | 8 | 48767911 | + | GACCCTGTCGAGTGCTGGAAGG | | 1 | 1 | 10 | SEQ ID NO. 3490 |
| (N20)NGG | 8 | 48767934 | + | ATTGTTTATCCATCCCTTATAGG | | 1 | 5 | 57 | SEQ ID NO. 3491 |
| (N20)NGG | 8 | 48767946 | - | TCCCTTATAGGTATGTTTACTGG | | 1 | 3 | 22 | SEQ ID NO. 3492 |
| (N20)NGG | 8 | 48767773 | - | TCTTTAGGGACCCCCTGAAAAGG | | 1 | 1 | 26 | SEQ ID NO. 3493 |
| (N20)NGG | 8 | 48767787 | - | TTGCTAACACTTCATCTTTAGG | | 1 | 5 | 57 | SEQ ID NO. 3494 |
| (N20)NGG | 8 | 48767788 | - | TTTGCTAACACTTCATCTTTAGG | | 1 | 3 | 81 | SEQ ID NO. 3495 |
| (N20)NGG | 8 | 48767826 | - | GATGAAAGACATGTTTCATTAGG | | 1 | 6 | 92 | SEQ ID NO. 3496 |
| (N20)NGG | 8 | 48767848 | - | TGTCTAAACACAGCTCTTTTTGG | | 1 | 1 | 59 | SEQ ID NO. 3497 |
| (N20)NGG | 8 | 48767874 | - | CAAGGTCTTTTATAATTTCAAGG | | 1 | 7 | 88 | SEQ ID NO. 3498 |
| (N20)NGG | 8 | 48767891 | - | ATCCTTCCAGCACTCGACAAGGG | | 1 | 2 | 12 | SEQ ID NO. 3499 |
| (N20)NGG | 8 | 48767892 | - | AATCCTTCCAGCACTCGACAAGG | | 1 | 1 | 19 | SEQ ID NO. 3500 |
| (N20)NGG | 8 | 48767921 | - | GTAAACATACCTATAAGGGATGG | | 1 | 2 | 25 | SEQ ID NO. 3501 |
| (N20)NGG | 8 | 48767925 | - | ACCAGTAAACATACCTATAAGGG | | 1 | 1 | 33 | SEQ ID NO. 3502 |
| (N20)NGG | 8 | 48767926 | - | AACCAGTAAACATACCTATAAGG | | 1 | 5 | 51 | SEQ ID NO. 3503 |
| (N20)NGG | 8 | 48769716 | + | TGACTTTTACATCTCTTGTAGG | | 1 | 7 | 62 | SEQ ID NO. 3504 |
| (N20)NGG | 8 | 48769742 | + | TTCGCCCTTACGCGAAGCACTGG | | 1 | 1 | 1 | SEQ ID NO. 3505 |
| (N20)NGG | 8 | 48769764 | + | GCTTAGCCCCTTGCTGCAGCTGG | | 1 | 2 | 28 | SEQ ID NO. 3506 |

FIG. 12 cont.

| site type | site_chr omosome | site_start_ nucleotide | site_s trand | target_site_sequence_wi th NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 8 | 48769783 | + | CTGGCTGCTTCTGAAAACAATGG | | 2 | 12 | 98 SEQ ID NO. 3507 |
| (N20)NGG | 8 | 48769786 | + | GCTGCTTCTGAAAACAATGGAGG | | 1 | 6 | 80 SEQ ID NO. 3508 |
| (N20)NGG | 8 | 48769792 | + | TCTGAAAACAATGGAGGAGAAGG | | 1 | 13 | 150 SEQ ID NO. 3509 |
| (N20)NGG | 8 | 48769806 | + | AGGAGAAGGAATTCACTACATGG | | 1 | 5 | 110 SEQ ID NO. 3510 |
| (N20)NGG | 8 | 48769809 | + | AGAAGGAATTCACTACATGTGG | | 1 | 2 | 66 SEQ ID NO. 3511 |
| (N20)NGG | 8 | 48769821 | + | CTACATGGTGTTGAGATAGTGG | | 1 | 3 | 47 SEQ ID NO. 3512 |
| (N20)NGG | 8 | 48769838 | + | TAGTGGCCACTATTCTTTTCATGG | | 1 | 4 | 31 SEQ ID NO. 3513 |
| (N20)NGG | 8 | 48769843 | + | GCCACTATTCTTTCATGGACAGG | | 1 | 1 | 13 SEQ ID NO. 3514 |
| (N20)NGG | 8 | 48769848 | + | TATTCTTTCATGGACAGGCTTGG | | 1 | 4 | 42 SEQ ID NO. 3515 |
| (N20)NGG | 8 | 48769865 | + | GCTTGGCCACTCCAACAGTAAGG | | 1 | 2 | 18 SEQ ID NO. 3516 |
| (N20)NGG | 8 | 48769706 | − | AAGGGCGAAAGACCTACAAGAGG | | 1 | 1 | 19 SEQ ID NO. 3517 |
| (N20)NGG | 8 | 48769724 | − | TAAGCCAGTGCTTCGCGTAAGG | | 1 | 1 | 3 SEQ ID NO. 3518 |
| (N20)NGG | 8 | 48769725 | − | CTAAGCCAGTGCTTCGCGTAAG | | 1 | 1 | 7 SEQ ID NO. 3519 |
| (N20)NGG | 8 | 48769748 | − | AAGCAGCCAGCTGCAGCAAGGG | | 1 | 1 | 83 SEQ ID NO. 3520 |
| (N20)NGG | 8 | 48769749 | − | GAAGCAGCCAGCTGCAGCAAGG | | 3 | 3 | 92 SEQ ID NO. 3521 |
| (N20)NGG | 8 | 48769750 | − | AGAAGCAGCCAGCTGCAGCAAGG | | 1 | 11 | 114 SEQ ID NO. 3522 |
| (N20)NGG | 8 | 48769822 | − | GCCTGTCCATGAAAGAATAGTGG | | 1 | 6 | 25 SEQ ID NO. 3523 |
| (N20)NGG | 8 | 48769849 | − | ATCAATCCTTACTGTTGGAGTGG | | 1 | 1 | 22 SEQ ID NO. 3524 |
| (N20)NGG | 8 | 48769854 | − | GATGCATCAATCCTTACTGTTGG | | 1 | 1 | 23 SEQ ID NO. 3525 |
| (N20)NGG | 8 | 48771076 | + | AATTTTGAATGTTTTATTTTAGG | | 2 | 82 | 1250 SEQ ID NO. 3526 |
| (N20)NGG | 8 | 48771105 | + | TGCCAAGAGATCTTCCTTCTTGG | | 1 | 4 | 62 SEQ ID NO. 3527 |
| (N20)NGG | 8 | 48771122 | + | TCTTGGATGAAATTCCTCCATGG | | 1 | 5 | 66 SEQ ID NO. 3528 |
| (N20)NGG | 8 | 48771130 | + | GAAATTCCTCCATGGCAAACTGG | | 1 | 2 | 34 SEQ ID NO. 3529 |
| (N20)NGG | 8 | 48771131 | + | AAATTCCTCCATGGCAAACTGGG | | 1 | 1 | 40 SEQ ID NO. 3530 |
| (N20)NGG | 8 | 48771196 | + | GCTTGTTATTAATACAGAAGAGG | | 1 | 3 | 56 SEQ ID NO. 3531 |
| (N20)NGG | 8 | 48771085 | − | ATCCAAGAAGGAAGATCTCTTGG | | 1 | 1 | 70 SEQ ID NO. 3532 |
| (N20)NGG | 8 | 48771097 | − | TGGAGGAATTCATCCAAGAAGG | | 2 | 7 | 77 SEQ ID NO. 3533 |
| (N20)NGG | 8 | 48771114 | − | GATTTCCCAGTTTGCCATGGAGG | | 1 | 4 | 27 SEQ ID NO. 3534 |
| (N20)NGG | 8 | 48771117 | − | TTGGATTTCCCAGTTTGCCATGG | | 1 | 4 | 70 SEQ ID NO. 3535 |
| (N20)NGG | 8 | 48771136 | − | CGGATATTTAATGGTACTATTGG | | 1 | 1 | 17 SEQ ID NO. 3536 |
| (N20)NGG | 8 | 48771145 | − | AAGAAGAGACGGATATTTAATGG | | 1 | 2 | 74 SEQ ID NO. 3537 |
| (N20)NGG | 8 | 48771156 | − | CAAGCTTGGTAAGAAGAGACGG | | 1 | 9 | 65 SEQ ID NO. 3538 |
| (N20)NGG | 8 | 48771170 | − | TTCTGTATTAATAACAAGCTTGG | | 2 | 4 | 79 SEQ ID NO. 3539 |

FIG. 12 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48771409 | + | TCCTGGGCCCTCCCTTTCGCAGG | 1 | 1 | 12 | 59 SEQ ID NO. 3540 |
| (N20)NGG | 8 | 48771417 | + | CCTCCCTTTCGCAGGAGCAGCGG | 1 | | 4 | 40 SEQ ID NO. 3541 |
| (N20)NGG | 8 | 48771418 | + | CTCCCTTTCGCAGGAGCAGCGGG | 1 | | 4 | 41 SEQ ID NO. 3542 |
| (N20)NGG | 8 | 48771427 | + | GCAGGAGCAGCGGGACCCCACGG | 1 | | 5 | 67 SEQ ID NO. 3543 |
| (N20)NGG | 8 | 48771445 | + | CACGGTGCATGATGATGTGCTGG | 1 | | 2 | 10 SEQ ID NO. 3544 |
| (N20)NGG | 8 | 48771451 | + | GCATGATGATGTGCTGGAGCTGG | 2 | | 2 | 33 SEQ ID NO. 3545 |
| (N20)NGG | 8 | 48771457 | + | TGATGTGCTGGAGCTGGAGATGG | 1 | | 8 | 102 SEQ ID NO. 3546 |
| (N20)NGG | 8 | 48771471 | + | TGGAGATGGACGAGCTCAATCGG | 1 | | 2 | 30 SEQ ID NO. 3547 |
| (N20)NGG | 8 | 48771484 | + | GCTCAATCGGCATGAGTGCATGG | 1 | | 1 | 7 SEQ ID NO. 3548 |
| (N20)NGG | 8 | 48771496 | + | TGAGTGCATGGCGCCCCTGACGG | 1 | | 1 | 14 SEQ ID NO. 3549 |
| (N20)NGG | 8 | 48771502 | + | CATGGCGCCCCTGACGGCCCTGG | 1 | | 1 | 14 SEQ ID NO. 3550 |
| (N20)NGG | 8 | 48771526 | + | CAAGCACATGCACAGAAGCCTGG | 1 | | 3 | 95 SEQ ID NO. 3551 |
| (N20)NGG | 8 | 48771527 | + | AAGCACATGCACAGAAGCCTGGG | 1 | | 2 | 71 SEQ ID NO. 3552 |
| (N20)NGG | 8 | 48771539 | + | AGAAGCCTGGCCCGCCCTCAAGG | 1 | | 1 | 36 SEQ ID NO. 3553 |
| (N20)NGG | 8 | 48771547 | + | GGGCCCGCCCTCAAGGAGAAGAGG | 1 | | 2 | 33 SEQ ID NO. 3554 |
| (N20)NGG | 8 | 48771388 | - | TCCTGCGAAAGGGAGGGCCCAGG | 1 | | 2 | 39 SEQ ID NO. 3555 |
| (N20)NGG | 8 | 48771394 | - | CGCTGCTCCTGCGAAAGGGAGGG | 1 | | 3 | 21 SEQ ID NO. 3556 |
| (N20)NGG | 8 | 48771395 | - | CCGCTGCTCCTGCGAAAGGGAGG | 1 | | 2 | 19 SEQ ID NO. 3557 |
| (N20)NGG | 8 | 48771398 | - | GTCCCGCTGCTCCTGCGAAAGGG | 1 | | 2 | 16 SEQ ID NO. 3558 |
| (N20)NGG | 8 | 48771399 | - | GGTCCCGCTGCTCCTGCGAAAGG | 1 | | 3 | 19 SEQ ID NO. 3559 |
| (N20)NGG | 8 | 48771420 | - | GCACATCATCATGCACCGTGGG | 1 | | 2 | 9 SEQ ID NO. 3560 |
| (N20)NGG | 8 | 48771421 | - | AGCACATCATCATGCACCGTGGG | 1 | | 2 | 12 SEQ ID NO. 3561 |
| (N20)NGG | 8 | 48771422 | - | CAGCACATCATCATGCACCGTGG | 1 | | 2 | 11 SEQ ID NO. 3562 |
| (N20)NGG | 8 | 48771487 | - | TGCTTGACCAGGGCCGTCAGGGG | 1 | | 1 | 19 SEQ ID NO. 3563 |
| (N20)NGG | 8 | 48771488 | - | GTGCTTGACCAGGGCCGTCAGGG | 1 | | 2 | 13 SEQ ID NO. 3564 |
| (N20)NGG | 8 | 48771489 | - | TGTGCTTGACCAGGGCCGTCAGG | 1 | | 1 | 7 SEQ ID NO. 3565 |
| (N20)NGG | 8 | 48771497 | - | TCTGTGCATGTGCTTGACCAGGG | 1 | | 3 | 59 SEQ ID NO. 3566 |
| (N20)NGG | 8 | 48771498 | - | TTCTGTGCATGTGCTTGACCAGG | 1 | | 3 | 47 SEQ ID NO. 3567 |
| (N20)NGG | 8 | 48771522 | - | CTTCTCCTTGAGGGGCCCAGG | 1 | | 4 | 34 SEQ ID NO. 3568 |
| (N20)NGG | 8 | 48771528 | - | GCACCTCTTCTCCTTGAGGCGG | 1 | | 4 | 34 SEQ ID NO. 3569 |
| (N20)NGG | 8 | 48771529 | - | AGCACCTCTTCTCCTTGAGGCGG | 1 | | 3 | 58 SEQ ID NO. 3570 |
| (N20)NGG | 8 | 48771532 | - | AAAAGCACCTCTTCTCCTTGAGG | 1 | | 5 | 79 SEQ ID NO. 3571 |
| (N20)NGG | 8 | 48772174 | + | CTCCTTTTTTATATTTCAGATGG | 2 | | 15 | 386 SEQ ID NO. 3572 |

FIG. 12 cont.

| site_type | site_chr omosome | site_start_ nucleotide | site_s trand | target_site_sequence_wi th_NGG | genome_wide_ hits_with_1 or_less_mism atches | genome_wide_ hits_with_ 2_or_less_m ismatches | genome_wide_ hits_with_ 3_or_less_mism atches | | |
|---|---|---|---|---|---|---|---|---|---|
| (N20)NGG | 8 | 48772206 | + | TATGTCTCCCTGTCATATTTGG | 1 | 1 | 6 | 55 | SEQ ID NO. 3573 |
| (N20)NGG | 8 | 48772227 | + | GGCAGACAGTACCCTGAGTGAGG | | 1 | 5 | 35 | SEQ ID NO. 3574 |
| (N20)NGG | 8 | 48772255 | + | AGTCAATTGATTTCTCAACCGG | 1 | 1 | 5 | 62 | SEQ ID NO. 3575 |
| (N20)NGG | 8 | 48772303 | + | CAAGACCCTAGACCTGCCACTGG | 1 | 1 | 3 | 55 | SEQ ID NO. 3576 |
| (N20)NGG | 8 | 48772313 | + | GACCTGCCACTGGTCGTTTTCGG | 1 | 1 | 1 | 6 | SEQ ID NO. 3577 |
| (N20)NGG | 8 | 48772319 | + | CCACTGGTCGTTTTCGGAGACGG | 1 | 1 | 2 | 9 | SEQ ID NO. 3578 |
| (N20)NGG | 8 | 48772320 | + | CACTGGTCGTTTTCGGAGACGGG | 1 | 1 | 1 | 5 | SEQ ID NO. 3579 |
| (N20)NGG | 8 | 48772154 | - | GACCATCTGAAATATAAAAAGG | 1 | 1 | 5 | 183 | SEQ ID NO. 3580 |
| (N20)NGG | 8 | 48772176 | - | GACAGGGAAGACATATAGGAAGG | 1 | 1 | 8 | 70 | SEQ ID NO. 3581 |
| (N20)NGG | 8 | 48772180 | - | ATATGACAGGGAAGACATATAGG | 1 | 1 | 2 | 55 | SEQ ID NO. 3582 |
| (N20)NGG | 8 | 48772192 | - | ACTGTCTGCCAAATATGACAGGG | 1 | 1 | 3 | 47 | SEQ ID NO. 3583 |
| (N20)NGG | 8 | 48772193 | - | TACTGTCTGCCAAATATGACAGG | 1 | 1 | 4 | 37 | SEQ ID NO. 3584 |
| (N20)NGG | 8 | 48772216 | - | TTGACTCATTTCCTCACTCAGGG | 1 | 1 | 8 | 81 | SEQ ID NO. 3585 |
| (N20)NGG | 8 | 48772217 | - | ATTGACTCATTTCCTCACTCAGG | 1 | 1 | 5 | 81 | SEQ ID NO. 3586 |
| (N20)NGG | 8 | 48772252 | - | GTATGAATAGCTCTGAACTCCGG | 1 | 1 | 1 | 28 | SEQ ID NO. 3587 |
| (N20)NGG | 8 | 48772279 | - | AGTGGCAGGTCTAGGGTCTTTGG | 1 | 1 | 1 | 26 | SEQ ID NO. 3588 |
| (N20)NGG | 8 | 48772280 | - | CAGTGGCAGGTCTAGGGTCTTGG | 1 | 1 | 2 | 41 | SEQ ID NO. 3589 |
| (N20)NGG | 8 | 48772286 | - | AACGACCAGTGGCAGGTCTAGGG | 1 | 1 | 1 | 5 | SEQ ID NO. 3590 |
| (N20)NGG | 8 | 48772287 | - | AAACGACCAGTGGCAGGTCTAGG | 1 | 1 | 1 | 15 | SEQ ID NO. 3591 |
| (N20)NGG | 8 | 48772293 | - | CTCCGAAAACGACCAGTGGCAGG | 1 | 1 | 1 | 3 | SEQ ID NO. 3592 |
| (N20)NGG | 8 | 48772297 | - | CCGTCTCCGAAAACGACCAGTGG | 1 | 1 | 1 | 3 | SEQ ID NO. 3593 |
| (N20)NGG | 8 | 48773459 | + | GTTTATTTGTTCTTTCCAATAGG | 1 | 1 | 2 | 105 | SEQ ID NO. 3594 |
| (N20)NGG | 8 | 48773468 | + | TTCTTTCCAATAGGTTCCTATGG | 1 | 1 | 2 | 38 | SEQ ID NO. 3595 |
| (N20)NGG | 8 | 48773497 | + | AGAAAAGTACATTGAAATTAGG | 1 | 1 | 19 | 349 | SEQ ID NO. 3596 |
| (N20)NGG | 8 | 48773523 | + | GAAGCCAGAGAAGCAGCAAATGG | 1 | 1 | 14 | 212 | SEQ ID NO. 3597 |
| (N20)NGG | 8 | 48773524 | + | AAGCCAGAGAAGCAGCAAATGGG | 1 | 2 | 7 | 141 | SEQ ID NO. 3598 |
| (N20)NGG | 8 | 48773525 | + | AGCCAGAGAAGCAGCAAATGGG | 1 | 1 | 9 | 150 | SEQ ID NO. 3599 |
| (N20)NGG | 8 | 48773532 | + | GAAGCAGCAAATGGGGATTCGG | 1 | 1 | 7 | 39 | SEQ ID NO. 3600 |
| (N20)NGG | 8 | 48773536 | + | CAGCAAATGGGGATTCAGGTAGG | 1 | 1 | 2 | 43 | SEQ ID NO. 3601 |
| (N20)NGG | 8 | 48773451 | - | TCTTTCCATAGGAACCTATTGGG | 1 | 1 | 3 | 50 | SEQ ID NO. 3602 |
| (N20)NGG | 8 | 48773452 | - | TTCTTTCCATAGGAACCTATTGG | 1 | 1 | 3 | 42 | SEQ ID NO. 3603 |
| (N20)NGG | 8 | 48773462 | - | TACTTTTCTTTCTTTCCATAGG | 1 | 5 | 51 | 869 | SEQ ID NO. 3604 |
| (N20)NGG | 8 | 48773505 | - | ATCCCCATTTGTGCTTCTCTGG | 1 | 1 | 3 | 52 | SEQ ID NO. 3605 |

FIG. 12 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48774688 | + | TAATTTTCTGTAGAAGTTGAGG |   | 1 | 8 | 83 SEQ ID NO. 3606 |
| (N20)NGG | 8 | 48774651 | - | GAAAATTATAGCGGCGCTTCAG | 1 | 1 | 1 | 2 SEQ ID NO. 3607 |
| (N20)NGG | 8 | 48774660 | - | CTTCTACAGGAAAATTATAGCGG |   | 1 | 3 | 50 SEQ ID NO. 3608 |
| (N20)NGG | 8 | 48774673 | - | TCACTCACCTCAACTTCTACAGG |   | 1 | 2 | 33 SEQ ID NO. 3609 |
| (N20)NGG | 8 | 48774964 | + | CGATGCATTTACAGAGAACATGG |   | 1 | 2 | 25 SEQ ID NO. 3610 |
| (N20)NGG | 8 | 48774968 | + | GCATTTACAGAGAACATGGCAGG |   | 1 | 6 | 58 SEQ ID NO. 3611 |
| (N20)NGG | 8 | 48774985 | + | GGCAGGAGAATCAGCTGCTGG |   | 1 | 5 | 74 SEQ ID NO. 3612 |
| (N20)NGG | 8 | 48774990 | + | GAGAGAATCAGCTGCTGGAGAGG |   | 1 | 7 | 88 SEQ ID NO. 3613 |
| (N20)NGG | 8 | 48775073 | + | AATGAGTTAAAATTTTACCAAGG |   | 1 | 14 | 204 SEQ ID NO. 3614 |
| (N20)NGG | 8 | 48775102 | + | GTTTAGTGAAAAACCAGAAAAGG |   | 2 | 12 | 108 SEQ ID NO. 3615 |
| (N20)NGG | 8 | 48775106 | + | AGTGAAAAACCAGAAAAGTAGG |   | 1 | 10 | 137 SEQ ID NO. 3616 |
| (N20)NGG | 8 | 48775118 | + | GAAAAGTAGGCCACTCCTACGG |   | 1 | 1 | 31 SEQ ID NO. 3617 |
| (N20)NGG | 8 | 48775002 | - | CGCAGTTGTATGCTGCACAATGG |   | 1 | 5 | 16 SEQ ID NO. 3618 |
| (N20)NGG | 8 | 48775025 | - | GACACAGCAGATGACAGATATGG |   | 1 | 6 | 62 SEQ ID NO. 3619 |
| (N20)NGG | 8 | 48775068 | - | TTTCACTAAAACAGAAAACCTTGG |   | 3 | 6 | 131 SEQ ID NO. 3620 |
| (N20)NGG | 8 | 48775093 | - | TAGGAGTGGCCTACCTTTTCTGG |   | 1 | 2 | 14 SEQ ID NO. 3621 |
| (N20)NGG | 8 | 48776001 | + | TACTCAAATCACCAAGAAGATGG |   | 1 | 5 | 106 SEQ ID NO. 3622 |
| (N20)NGG | 8 | 48776002 | + | ACTCAAATCACCAAGAAGATGGG |   | 1 | 5 | 87 SEQ ID NO. 3623 |
| (N20)NGG | 8 | 48776064 | + | CAAAGATGATGTTCATGCTAAGG |   | 1 | 2 | 46 SEQ ID NO. 3624 |
| (N20)NGG | 8 | 48776092 | + | AAAATTAATCAAGTTTTCCATGG |   | 1 | 16 | 209 SEQ ID NO. 3625 |
| (N20)NGG | 8 | 48776110 | + | CATGGCTCGTGTATTACAGAAGG |   | 1 | 1 | 14 SEQ ID NO. 3626 |
| (N20)NGG | 8 | 48776159 | + | AGTAAGATTTTACTTAATTTTGG |   | 1 | 19 | 212 SEQ ID NO. 3627 |
| (N20)NGG | 8 | 48775948 | - | AGATTCATTTAGCTTCAAAAAGG |   | 1 | 7 | 113 SEQ ID NO. 3628 |
| (N20)NGG | 8 | 48775972 | - | CTTGGTGATTTGAGTATCAAAGG |   | 1 | 4 | 37 SEQ ID NO. 3629 |
| (N20)NGG | 8 | 48775990 | - | CTTATAGTAGCCCATCTTCTTGG |   | 1 | 2 | 16 SEQ ID NO. 3630 |
| (N20)NGG | 8 | 48776036 | - | CATGAACATCATCTTTGGAAGG |   | 1 | 2 | 53 SEQ ID NO. 3631 |
| (N20)NGG | 8 | 48776040 | - | TTAGCATGAACATCATCTTTGG |   | 1 | 7 | 75 SEQ ID NO. 3632 |
| (N20)NGG | 8 | 48776041 | - | CTTAGCATGAACATCATCTTTGG |   | 1 | 4 | 43 SEQ ID NO. 3633 |
| (N20)NGG | 8 | 48776087 | - | CTTCTGTAATACACGAGCCATGG |   | 1 | 2 | 12 SEQ ID NO. 3634 |
| (N20)NGG | 8 | 48777116 | + | TAATTTTATCTGTTTTCTTAGG |   | 2 | 39 | 787 SEQ ID NO. 3635 |
| (N20)NGG | 8 | 48777117 | + | AATTTTATCTGTTTTTCTTAGGG |   | 3 | 43 | 561 SEQ ID NO. 3636 |
| (N20)NGG | 8 | 48777118 | + | ATTTTATCTGTTTTTCTTAGGGG |   | 2 | 25 | 472 SEQ ID NO. 3637 |
| (N20)NGG | 8 | 48777139 | + | GGTTCATGTGTCACACAAGTAGG | 1 | 1 | 1 | 27 SEQ ID NO. 3638 |

FIG. 12 cont.

| site_type | site_chr omosome | site_start_ nucleotide | site_s trand | target_site_sequence_wi th NGG | genome_wide_ hits_with_1_ or_less_mism atches | genome_wide_ hits_with_ 2_or_less_m ismatches | genome_wide_ hits_with_3_ or_less_mism atches | | |
|---|---|---|---|---|---|---|---|---|---|
| (N20)NGG | 8 | 48777147 | + | TGTCACACAAGTAGGCCTTCTGG | | 1 | 3 | 26 | SEQ ID NO. 3639 |
| (N20)NGG | 8 | 48777170 | + | AAAGCGTGTATGAAATGTTCAGG | | 1 | 1 | 15 | SEQ ID NO. 3640 |
| (N20)NGG | 8 | 48777174 | + | CGTGTATGAAATGTTCAGGAAGG | | 2 | 9 | 99 | SEQ ID NO. 3641 |
| (N20)NGG | 8 | 48777213 | + | TTTCACACGCCAGTCCTTTGTGG | | 1 | 1 | 18 | SEQ ID NO. 3642 |
| (N20)NGG | 8 | 48777239 | + | GCTCCCTCCTCACTCTGCTGTGG | | 2 | 13 | 147 | SEQ ID NO. 3643 |
| (N20)NGG | 8 | 48777252 | + | TCTGCTGTGGCACTGTAGCCTGG | | 1 | 4 | 58 | SEQ ID NO. 3644 |
| (N20)NGG | 8 | 48777285 | + | AGAATTCTTCAGCACAATTGTGG | | 1 | 2 | 52 | SEQ ID NO. 3645 |
| (N20)NGG | 8 | 48777288 | + | ATTCTTCAGCACAATTGTGGTGG | | 2 | 3 | 39 | SEQ ID NO. 3646 |
| (N20)NGG | 8 | 48777314 | + | CCATTGATGTGTTGAAGTCCAGG | | 1 | 3 | 62 | SEQ ID NO. 3647 |
| (N20)NGG | 8 | 48777324 | + | GTTGAAGTCCAGGTTTACAAAGG | | 1 | 2 | 29 | SEQ ID NO. 3648 |
| (N20)NGG | 8 | 48777140 | - | TTTCATACACGCTTTCCAGAAGG | | 1 | 4 | 28 | SEQ ID NO. 3649 |
| (N20)NGG | 8 | 48777179 | - | GGCGTGTGAAACTTAGGCGGGGG | | 1 | 3 | 6 | SEQ ID NO. 3650 |
| (N20)NGG | 8 | 48777180 | - | TGGCGTGTGAAACTTAGGCGGGG | | 1 | 1 | 4 | SEQ ID NO. 3651 |
| (N20)NGG | 8 | 48777181 | - | CTGGCGTGTGAAACTTAGGCGGG | | 1 | 1 | 16 | SEQ ID NO. 3652 |
| (N20)NGG | 8 | 48777182 | - | ACTGGCGTGTGAAACTTAGGCGG | | 2 | 3 | 14 | SEQ ID NO. 3653 |
| (N20)NGG | 8 | 48777185 | - | AGGACTGGCGTGTGAAACTTAGG | | 1 | 2 | 8 | SEQ ID NO. 3654 |
| (N20)NGG | 8 | 48777200 | - | GGGAGCGCGGTCCACAAGGACTGG | | 1 | 2 | 10 | SEQ ID NO. 3655 |
| (N20)NGG | 8 | 48777205 | - | GAGGAGGAGCGGTCCACAAAGG | | 1 | 2 | 48 | SEQ ID NO. 3656 |
| (N20)NGG | 8 | 48777215 | - | ACAGCAGAGTGAGGAGGAGCGG | | 1 | 30 | 331 | SEQ ID NO. 3657 |
| (N20)NGG | 8 | 48777220 | - | GTGCCACAGCAGAGTGAGGAGGG | | 1 | 9 | 88 | SEQ ID NO. 3658 |
| (N20)NGG | 8 | 48777221 | - | AGTGCCACAGCAGAGTGAGGAGG | | 1 | 6 | 74 | SEQ ID NO. 3659 |
| (N20)NGG | 8 | 48777224 | - | TACAGTGCCACAGCAGAGTGAGG | | 1 | 3 | 41 | SEQ ID NO. 3660 |
| (N20)NGG | 8 | 48777248 | - | AGAATTCTTCAAAGCATCCAGG | | 1 | 3 | 51 | SEQ ID NO. 3661 |
| (N20)NGG | 8 | 48777292 | - | CCTGGACTTCAACACATCAATGG | | 1 | 2 | 33 | SEQ ID NO. 3662 |
| (N20)NGG | 8 | 48777310 | - | GTATGATACCTTTGTAAACCTGG | | 1 | 2 | 23 | SEQ ID NO. 3663 |
| (N20)NGG | 8 | 48790299 | + | TTTCTAGTTTCTAGATGCATTGG | | 1 | 5 | 96 | SEQ ID NO. 3664 |
| (N20)NGG | 8 | 48790326 | + | ATCTCAAAGCCCTATGTTGTTGG | | 1 | 1 | 25 | SEQ ID NO. 3665 |
| (N20)NGG | 8 | 48790352 | + | TGATGACAGAAGTTCTTTGTCGG | | 2 | 4 | 59 | SEQ ID NO. 3666 |
| (N20)NGG | 8 | 48790353 | + | GATGACAGAAGTTCTTTGTCGGG | | 1 | 3 | 36 | SEQ ID NO. 3667 |
| (N20)NGG | 8 | 48790371 | + | TCGGAACAGCAGCATGTCATGG | | 1 | 1 | 17 | SEQ ID NO. 3668 |
| (N20)NGG | 8 | 48790397 | + | AATTATTTCAATCCAGTTTCAGG | | 2 | 6 | 114 | SEQ ID NO. 3669 |
| (N20)NGG | 8 | 48790400 | + | TATTTCAATCCAGTTTCAGGAGG | | 1 | 1 | 55 | SEQ ID NO. 3670 |
| (N20)NGG | 8 | 48790412 | + | GTTTCAGGAGGATTGCCAGAAGG | | 1 | 2 | 26 | SEQ ID NO. 3671 |

| site_type | site_chr omosome | site_start_ nucleotide | site_s trand | target_site_sequence_wi th NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 8 | 48790425 | + | TGCCAGAAGGTAAGTCATTCTGG | 1 | 2 | 39 | SEQ ID NO. 3672 |
| (N20)NGG | 8 | 48790430 | + | GAAGGTAAGTCATTCTGGCCTGG | 1 | 5 | 28 | SEQ ID NO. 3673 |
| (N20)NGG | 8 | 48790431 | + | AAGGTAAGTCATTCTGGCCTGGG | 1 | 2 | 44 | SEQ ID NO. 3674 |
| (N20)NGG | 8 | 48790313 | - | TCATCAATTCCAACAACATAGGG | 1 | 1 | 58 | SEQ ID NO. 3675 |
| (N20)NGG | 8 | 48790314 | - | GTCATCAATTCCAACAACATAGG | 1 | 2 | 32 | SEQ ID NO. 3676 |
| (N20)NGG | 8 | 48790387 | - | TCTGGCAATCCTCCTGAAACTGG | 1 | 2 | 19 | SEQ ID NO. 3677 |
| (N20)NGG | 8 | 48790405 | - | GGCCAGAATGACTTACCTTCTGG | 1 | 3 | 28 | SEQ ID NO. 3678 |
| (N20)NGG | 8 | 48792051 | + | TTATGTCTGTCTTGCTCCACAGG | 1 | 5 | 79 | SEQ ID NO. 3679 |
| (N20)NGG | 8 | 48792052 | + | TATGTCTGTCTTGCTCCACAGGG | 1 | 6 | 71 | SEQ ID NO. 3680 |
| (N20)NGG | 8 | 48792094 | + | CCATTCTTCACCAGCCTCACTGG | 1 | 7 | 88 | SEQ ID NO. 3681 |
| (N20)NGG | 8 | 48792097 | + | TTCTTCACCAGCCTCACTGGAGG | 1 | 6 | 80 | SEQ ID NO. 3682 |
| (N20)NGG | 8 | 48792105 | + | CAGCCTCACTGGAGGCAGTCTGG | 1 | 2 | 56 | SEQ ID NO. 3683 |
| (N20)NGG | 8 | 48792108 | + | CCTCACTGGAGGCAGTCTGGAGG | 1 | 8 | 65 | SEQ ID NO. 3684 |
| (N20)NGG | 8 | 48792126 | + | GGAGGAACTTAGACGTGTTCTGG | 1 | 2 | 11 | SEQ ID NO. 3685 |
| (N20)NGG | 8 | 48792164 | + | CTCACTTCCCCATGCAGTCCAGG | 2 | 6 | 45 | SEQ ID NO. 3686 |
| (N20)NGG | 8 | 48792165 | + | TCACTTCCCCATGCAGTCCAGGG | 2 | 2 | 48 | SEQ ID NO. 3687 |
| (N20)NGG | 8 | 48792178 | + | CAGTCCAGGGAATTTCCTCCAGG | 1 | 3 | 60 | SEQ ID NO. 3688 |
| (N20)NGG | 8 | 48792188 | + | AATTTCCTCCAGGAACTCCGCGG | 1 | 2 | 25 | SEQ ID NO. 3689 |
| (N20)NGG | 8 | 48792204 | + | TCCGCGGTTCAATAATTATGTGG | 1 | 1 | 5 | SEQ ID NO. 3690 |
| (N20)NGG | 8 | 48792219 | + | TTATGTGGACTGCATGAAAAAGG | 1 | 4 | 44 | SEQ ID NO. 3691 |
| (N20)NGG | 8 | 48792045 | - | AGAGTGACAGCTTGGCCCTGTGG | 1 | 6 | 58 | SEQ ID NO. 3692 |
| (N20)NGG | 8 | 48792053 | - | ATGGAAGAAGAGTGACAGCTTGG | 1 | 5 | 75 | SEQ ID NO. 3693 |
| (N20)NGG | 8 | 48792072 | - | CCAGTGAGGCTGGTGAAGAATGG | 1 | 11 | 115 | SEQ ID NO. 3694 |
| (N20)NGG | 8 | 48792082 | - | CAGACTGCCTCCAGTGAGGCTGG | 2 | 2 | 39 | SEQ ID NO. 3695 |
| (N20)NGG | 8 | 48792086 | - | CCTCCAGACTGCCTCCAGTGAGG | 1 | 7 | 58 | SEQ ID NO. 3696 |
| (N20)NGG | 8 | 48792149 | - | GAAATTCCCTGGACTGCATGGGG | 1 | 3 | 33 | SEQ ID NO. 3697 |
| (N20)NGG | 8 | 48792150 | - | GGAAATTCCCTGGACTGCATGGG | 1 | 3 | 24 | SEQ ID NO. 3698 |
| (N20)NGG | 8 | 48792151 | - | AGGAAATTCCCTGGACTGCATGG | 1 | 5 | 49 | SEQ ID NO. 3699 |
| (N20)NGG | 8 | 48792160 | - | AGTTCCTGGAGAAATTCCCTGG | 1 | 5 | 30 | SEQ ID NO. 3700 |
| (N20)NGG | 8 | 48792171 | - | TTGAACCGCGGAGTTCCTGGAGG | 1 | 3 | 16 | SEQ ID NO. 3701 |
| (N20)NGG | 8 | 48792174 | - | TTATTGAACCGCGGAGTTCCTGG | 1 | 1 | 3 | SEQ ID NO. 3702 |
| (N20)NGG | 8 | 48792183 | - | TCCACATAATTATTGAACCGCGG | 1 | 1 | 12 | SEQ ID NO. 3703 |
| (N20)NGG | 8 | 48794010 | + | GTATCTTTTAATACAAGTCATGG | 1 | 3 | 58 | SEQ ID NO. 3704 |

| site_type | site_chr omosome | site_start_ nucleotide | site_s trand | target_site_sequence_wi th_NGG | genome_wide_ hits_with_1 or_less_mism atches | genome_wide_ hits_with_ 2_or_less_m ismatches | genome_wide_ hits_with_ 3_or_less_mism atches | | |
|---|---|---|---|---|---|---|---|---|---|
| (N20)NGG | 8 | 48794066 | + | TCTACTTGCTGACACAAAGCTGG |  |  | 2 | 39 | SEQ ID NO. 3705 |
| (N20)NGG | 8 | 48794081 | + | AAAGCTGGATCTACATTTAAAGG | 1 |  | 4 | 64 | SEQ ID NO. 3706 |
| (N20)NGG | 8 | 48793951 | - | AAAGGAAGGAAAAGAAAAACAGG | 1 | 16 | 314 | 5097 | SEQ ID NO. 3707 |
| (N20)NGG | 8 | 48793965 | - | AGATGAATCAATCTAAAGGAAGG | 1 |  | 5 | 137 | SEQ ID NO. 3708 |
| (N20)NGG | 8 | 48793969 | - | ATACAGATGAATCAATCTAAAGG |  |  | 4 | 92 | SEQ ID NO. 3709 |
| (N20)NGG | 8 | 48794017 | - | TATATGTTGTAAAGACTTCAGGG | 1 |  | 2 | 86 | SEQ ID NO. 3710 |
| (N20)NGG | 8 | 48794018 | - | ATATATGTTGTAAAGACTTCAGG | 1 |  | 6 | 66 | SEQ ID NO. 3711 |
| (N20)NGG | 8 | 48794472 | + | ACTCACAACGAAATTGTCTCAGG | 1 |  | 2 | 16 | SEQ ID NO. 3712 |
| (N20)NGG | 8 | 48794491 | + | CAGGTGAGTGCCGTTTTGAACGG | 1 |  | 1 | 17 | SEQ ID NO. 3713 |
| (N20)NGG | 8 | 48794513 | + | GCATGTTAGACCAGAGCTTCAGG | 1 |  | 1 | 21 | SEQ ID NO. 3714 |
| (N20)NGG | 8 | 48794514 | + | CATGTTAGACCAGAGCTTCAGGG | 1 |  | 1 | 30 | SEQ ID NO. 3715 |
| (N20)NGG | 8 | 48794539 | + | CGAGCAAACCAGAAACACCAAGG | 1 |  | 3 | 39 | SEQ ID NO. 3716 |
| (N20)NGG | 8 | 48794573 | + | CGACTACAATTCTGCAACACTGG | 1 |  | 2 | 10 | SEQ ID NO. 3717 |
| (N20)NGG | 8 | 48794591 | + | ACTCGAAGAAGTGTGATTCATGG | 1 |  | 2 | 62 | SEQ ID NO. 3718 |
| (N20)NGG | 8 | 48794594 | + | GGAAGAAGTGTGATTCATGGTGG | 1 |  | 6 | 100 | SEQ ID NO. 3719 |
| (N20)NGG | 8 | 48794595 | + | GAAGAAGTGTGATTCATGGTGGG | 1 |  | 4 | 68 | SEQ ID NO. 3720 |
| (N20)NGG | 8 | 48794625 | + | TTCCCCTCTGAAACTAAAATGG | 1 |  | 1 | 30 | SEQ ID NO. 3721 |
| (N20)NGG | 8 | 48794634 | - | CGAAACTAAAATGGCAGTGCTGG | 1 |  | 1 | 15 | SEQ ID NO. 3722 |
| (N20)NGG | 8 | 48794643 | - | AATGGCAGTGCTGGCCTTACTGG | 1 |  | 6 | 50 | SEQ ID NO. 3723 |
| (N20)NGG | 8 | 48794658 | + | CTTACTGGCAAAATTTTACAGG | 1 |  | 3 | 63 | SEQ ID NO. 3724 |
| (N20)NGG | 8 | 48794479 | - | GTCTAACATGCCCTTCAAAACGG | 1 |  | 1 | 7 | SEQ ID NO. 3725 |
| (N20)NGG | 8 | 48794501 | - | TTGGCTCGCTTCCCTGAAGCTCTGG | 1 |  | 2 | 27 | SEQ ID NO. 3726 |
| (N20)NGG | 8 | 48794525 | - | GTTTCAGTCCTTGGTGTTTCTGG | 2 |  | 7 | 69 | SEQ ID NO. 3727 |
| (N20)NGG | 8 | 48794534 | - | TAGTCGCAAGTTTCAGTCCTTGG | 1 |  | 1 | 14 | SEQ ID NO. 3728 |
| (N20)NGG | 8 | 48794596 | - | AGTTTCGAGAGGGAATCTTTGG | 1 |  | 1 | 17 | SEQ ID NO. 3729 |
| (N20)NGG | 8 | 48794605 | - | TGCCATTTTAGTTTCGAGAGGGG | 1 |  | 3 | 22 | SEQ ID NO. 3730 |
| (N20)NGG | 8 | 48794606 | - | CTGCCATTTTAGTTTCGAGAGGG | 1 |  | 1 | 22 | SEQ ID NO. 3731 |
| (N20)NGG | 8 | 48794607 | - | ACTGCCATTTTAGTTTCGAGAGG | 1 |  | 1 | 24 | SEQ ID NO. 3732 |
| (N20)NGG | 8 | 48794635 | - | CTGTAAAATTTTTGCCAGTAAGG | 2 |  | 5 | 93 | SEQ ID NO. 3733 |
| (N20)NGG | 8 | 48798540 | + | GAGTCTTTCTCCTGAACCAGCGG | 1 |  | 4 | 63 | SEQ ID NO. 3734 |
| (N20)NGG | 8 | 48798552 | + | GAACCCAGCGGTGCTGTCCACGG | 1 |  | 2 | 25 | SEQ ID NO. 3735 |
| (N20)NGG | 8 | 48798561 | + | GGTGCTGTCCACGCGGTCCTTGG |  |  | 2 | 19 | SEQ ID NO. 3736 |
| (N20)NGG | 8 | 48798562 | + | GTGCTGTCCACGGCGGTCCTTGGG |  |  | 1 | 5 | SEQ ID NO. 3737 |

FIG. 12 cont.

| site type | site chr omosome | site_start_ nucleotide | site s trand | target_site_sequence wi th NGG | genome wide hits with 1 or less mism atches | genome wide hits with 2 or less m ismatches | genome wide hits with m or less m ismatches | genome wide hits with 3 or less mism atches | |
|---|---|---|---|---|---|---|---|---|---|
| (N20)NGG | 8 | 48798573 | + | GGCGTCCTTGGGCAGCTCACAGG | | 1 | 4 | 27 | SEQ ID NO. 3738 |
| (N20)NGG | 8 | 48798574 | + | GCGTCCTTGGGCAGCTCACAGGG | | 1 | 5 | 35 | SEQ ID NO. 3739 |
| (N20)NGG | 8 | 48798598 | + | AGCGTCATCCACTTCTCCCATGG | | 1 | 1 | 20 | SEQ ID NO. 3740 |
| (N20)NGG | 8 | 48798599 | + | GCGTCATCCACTTCTCCCATGGG | | 1 | 2 | 13 | SEQ ID NO. 3741 |
| (N20)NGG | 8 | 48798600 | + | CGTCATCCACTTCTCCCATGGGG | | 1 | 2 | 28 | SEQ ID NO. 3742 |
| (N20)NGG | 8 | 48798639 | + | GTTCTCAGAAACGATCAACACGG | | 1 | 4 | 50 | SEQ ID NO. 3743 |
| (N20)NGG | 8 | 48798657 | + | CACGGAATTATTGAAAAATCTGG | | 1 | 2 | 61 | SEQ ID NO. 3744 |
| (N20)NGG | 8 | 48798672 | + | AAATCTGATCTTGCTGTATTGG | | 1 | 6 | 96 | SEQ ID NO. 3745 |
| (N20)NGG | 8 | 48798693 | + | GGAGCTCATGCAGTCTTCAGTGG | | 1 | 1 | 55 | SEQ ID NO. 3746 |
| (N20)NGG | 8 | 48798708 | + | TTCAGTGGATAATACCAAAATGG | | 2 | 8 | 63 | SEQ ID NO. 3747 |
| (N20)NGG | 8 | 48798488 | - | GCTCACACTGGGAAAAAGAAAGG | | 1 | 7 | 95 | SEQ ID NO. 3748 |
| (N20)NGG | 8 | 48798499 | - | ACTCACAAGGCGCTCACACTGGG | | 1 | 2 | 17 | SEQ ID NO. 3749 |
| (N20)NGG | 8 | 48798500 | - | GACTCACAAGGCGCTCACACTGG | | 1 | 1 | 8 | SEQ ID NO. 3750 |
| (N20)NGG | 8 | 48798512 | - | GGTTCAGGAGAAGACTCACAAGG | | 1 | 2 | 46 | SEQ ID NO. 3751 |
| (N20)NGG | 8 | 48798527 | - | TGGACAGCACCGCTGGGTTCAGG | | 1 | 3 | 36 | SEQ ID NO. 3752 |
| (N20)NGG | 8 | 48798533 | - | ACGCCGTGGACAGCACCGCTGGG | | 1 | 1 | 8 | SEQ ID NO. 3753 |
| (N20)NGG | 8 | 48798534 | - | GACGCCGTGGACAGCACCGCTGG | | 1 | 2 | 6 | SEQ ID NO. 3754 |
| (N20)NGG | 8 | 48798547 | - | TGAGCTGCCCAAGGACGCGTGG | | 1 | 2 | 26 | SEQ ID NO. 3755 |
| (N20)NGG | 8 | 48798556 | - | GCTGCCCTGTGAGCTGCCCAAGG | | 3 | 9 | 101 | SEQ ID NO. 3756 |
| (N20)NGG | 8 | 48798584 | - | AATACTCCCATGGAGAAGTGG | | 1 | 2 | 37 | SEQ ID NO. 3757 |
| (N20)NGG | 8 | 48798592 | - | GCTATAGAAATACTCCCATGGG | | 1 | 3 | 21 | SEQ ID NO. 3758 |
| (N20)NGG | 8 | 48798593 | - | AGCTATAGAAATACTCCCATGG | | 1 | 2 | 34 | SEQ ID NO. 3759 |
| (N20)NGG | 8 | 48798700 | - | GGGAAACTTTGTTACCATTTTGG | | 1 | 4 | 53 | SEQ ID NO. 3760 |
| (N20)NGG | 8 | 48800132 | + | ACAGATTTGCATCATTCTGTTGG | | 3 | 10 | 73 | SEQ ID NO. 3761 |
| (N20)NGG | 8 | 48800152 | + | TGGCACAGAACTTCTTTCCCTGG | | 1 | 7 | 55 | SEQ ID NO. 3762 |
| (N20)NGG | 8 | 48800162 | + | CTTCTTTCCCTGGTTTATAAAGG | | 1 | 3 | 111 | SEQ ID NO. 3763 |
| (N20)NGG | 8 | 48800174 | + | GTTTATAAAGCATTGCCCCTGG | | 1 | 1 | 27 | SEQ ID NO. 3764 |
| (N20)NGG | 8 | 48800224 | + | AGACCTCAGTTGTAAGCAGCTGG | | 1 | 4 | 21 | SEQ ID NO. 3765 |
| (N20)NGG | 8 | 48800231 | + | AGTTGTAAGCAGCTGGCCAGCGG | | 1 | 3 | 27 | SEQ ID NO. 3766 |
| (N20)NGG | 8 | 48800239 | + | GCAGCTGGCCAGCGGACTTCTGG | | 1 | 2 | 26 | SEQ ID NO. 3767 |
| (N20)NGG | 8 | 48800258 | + | CTGGAGTTAGCCTTTGCTTTTGG | | 1 | 3 | 44 | SEQ ID NO. 3768 |
| (N20)NGG | 8 | 48800261 | + | GAGTTAGCCTTTGCTTTTGGAGG | | 1 | 4 | 52 | SEQ ID NO. 3769 |
| (N20)NGG | 8 | 48800266 | + | AGCCTTTGCTTTTGGAGGACTGG | | 1 | 1 | 43 | SEQ ID NO. 3770 |

FIG. 12 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 8 | 48800270 | + | TTTGCTTTTGGAGGACTGTAGG | 1 | 3 | 49 | SEQ ID NO. | 3771 |
| (N20)NGG | 8 | 48800099 | - | ATGCAAATCTGTGGACTAAAAGG | 1 | 3 | 62 | SEQ ID NO. | 3772 |
| (N20)NGG | 8 | 48800108 | - | AACAGAATGATGCAAATCTGTGG | 1 | 6 | 89 | SEQ ID NO. | 3773 |
| (N20)NGG | 8 | 48800147 | - | GGCAATGCCTTTATAAACCAGG | 1 | 2 | 45 | SEQ ID NO. | 3774 |
| (N20)NGG | 8 | 48800148 | - | GGGCAATGCCTTTATAAACCAGG | 1 | 1 | 31 | SEQ ID NO. | 3775 |
| (N20)NGG | 8 | 48800168 | - | ACACTGTCTCTCATCTCCAGGGG | 1 | 3 | 83 | SEQ ID NO. | 3776 |
| (N20)NGG | 8 | 48800169 | - | GACACTGTCTCTCATCTCCAGG | 1 | 6 | 89 | SEQ ID NO. | 3777 |
| (N20)NGG | 8 | 48800170 | - | AGACACTGTCTCTCATCTCCAGG | 1 | 3 | 99 | SEQ ID NO. | 3778 |
| (N20)NGG | 8 | 48800194 | - | TTACAACTGAGGTCTAGAGAAGG | 1 | 3 | 50 | SEQ ID NO. | 3779 |
| (N20)NGG | 8 | 48800205 | - | TGGCCAGCTGCTTACAACTGAGG | 1 | 1 | 35 | SEQ ID NO. | 3780 |
| (N20)NGG | 8 | 48800225 | - | GGCTAACTCCAGAAGTCCGCTGG | 1 | 1 | 51 | SEQ ID NO. | 3781 |
| (N20)NGG | 8 | 48800246 | - | TACCAGTCTCTCCAAAAGCAAAGG | 1 | 3 | 49 | SEQ ID NO. | 3782 |
| (N20)NGG | 8 | 48801085 | + | TTGTCACATGGCCAGCATTGAGG | 1 | 2 | 44 | SEQ ID NO. | 3783 |
| (N20)NGG | 8 | 48801110 | + | CTTTGTGCCGTCAACTTGTATGG | 1 | 1 | 11 | SEQ ID NO. | 3784 |
| (N20)NGG | 8 | 48801127 | + | GTATGGCCCTGACGCGCAAGTGG | 1 | 1 | 4 | SEQ ID NO. | 3785 |
| (N20)NGG | 8 | 48801132 | + | GCCCTGACCGCAAGTGGACAGG | 1 | 1 | 1 | SEQ ID NO. | 3786 |
| (N20)NGG | 8 | 48801138 | + | ACGCGCAAGTGGACAGGAGCAGG | 1 | 1 | 4 | SEQ ID NO. | 3787 |
| (N20)NGG | 8 | 48801142 | + | GCAAGTGGACAGGAGCAGGCTGG | 1 | 5 | 85 | SEQ ID NO. | 3788 |
| (N20)NGG | 8 | 48801182 | + | TGTAAACAGCTTCACAGAGCTGG | 1 | 4 | 64 | SEQ ID NO. | 3789 |
| (N20)NGG | 8 | 48801183 | + | GTAAACAGCTTCACAGAGCTGGG | 1 | 3 | 49 | SEQ ID NO. | 3790 |
| (N20)NGG | 8 | 48801211 | + | GCATAATATATTACCGTCTCAGG | 1 | 2 | 16 | SEQ ID NO. | 3791 |
| (N20)NGG | 8 | 48801074 | - | GGCACAAAGCTCCTCAATGCTGG | 1 | 1 | 18 | SEQ ID NO. | 3792 |
| (N20)NGG | 8 | 48801095 | - | GTCAGGGCCATACAAGTTGACGG | 1 | 1 | 18 | SEQ ID NO. | 3793 |
| (N20)NGG | 8 | 48801111 | - | TCCTGTCCACTTGCGCGTCAGG | 1 | 1 | 8 | SEQ ID NO. | 3794 |
| (N20)NGG | 8 | 48801112 | - | CTCCTGTCCACTTGCGCGTCAGG | 1 | 1 | 7 | SEQ ID NO. | 3795 |
| (N20)NGG | 8 | 48801158 | - | AGCTCTGTGAAGCTGTTTACAGG | 1 | 2 | 42 | SEQ ID NO. | 3796 |
| (N20)NGG | 8 | 48801202 | - | TAAGTTATAGTTACCTGAGACGG | 1 | 2 | 38 | SEQ ID NO. | 3797 |
| (N20)NGG | 8 | 48801586 | + | TCTGTTACAGCTCCTGAAGAAGG | 1 | 3 | 92 | SEQ ID NO. | 3798 |
| (N20)NGG | 8 | 48801619 | + | TACACCTGATGAGAGTCCTGG | 1 | 4 | 20 | SEQ ID NO. | 3799 |
| (N20)NGG | 8 | 48801650 | + | CTGTGTGACCCGCAAGCATAGG | 1 | 2 | 29 | SEQ ID NO. | 3800 |
| (N20)NGG | 8 | 48801662 | + | GCAAGCATAGGTTTCAACATCGG | 1 | 1 | 26 | SEQ ID NO. | 3801 |
| (N20)NGG | 8 | 48801673 | + | TTTCAACATGGAGACGTCCAGG | 1 | 1 | 3 | SEQ ID NO. | 3802 |
| (N20)NGG | 8 | 48801679 | + | CATCGGAGACGTCCAGGTTATGG | 1 | 1 | 13 | SEQ ID NO. | 3803 |

FIG. 12 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48801783 | + | GAGAGAAAATAACAGCACAGAGG | 1 | 9 | 175 | SEQ ID NO. 3804 |
| (N20)NGG | 8 | 48801786 | + | AGAAATAACAGCACAGAGGTGG | 2 | 12 | 229 | SEQ ID NO. 3805 |
| (N20)NGG | 8 | 48801787 | + | GAAAATAACAGCACAGAGGTGGG | 1 | 15 | 119 | SEQ ID NO. 3806 |
| (N20)NGG | 8 | 48801794 | + | ACAGCACAGAGGTGGGTACTTGG | 1 | 4 | 50 | SEQ ID NO. 3807 |
| (N20)NGG | 8 | 48801795 | + | CAGCACAGAGGTGGGTACTTGGG | | 4 | 52 | SEQ ID NO. 3808 |
| (N20)NGG | 8 | 48801805 | + | GTGGGTACTTGGGTCACAATCGG | 1 | 1 | 14 | SEQ ID NO. 3809 |
| (N20)NGG | 8 | 48801806 | + | TGGGTACTTGGGTCACAATCGGG | 1 | 3 | 30 | SEQ ID NO. 3810 |
| (N20)NGG | 8 | 48801807 | + | GGGTACTTGGGTCACAATCGGGG | 1 | 2 | 8 | SEQ ID NO. 3811 |
| (N20)NGG | 8 | 48801576 | – | TATTACACAAGTCCTTCTTCAGG | 1 | 3 | 37 | SEQ ID NO. 3812 |
| (N20)NGG | 8 | 48801603 | – | TCTGCACCAGGACTCTCATCAGG | 1 | 3 | 38 | SEQ ID NO. 3813 |
| (N20)NGG | 8 | 48801615 | – | GCTCACACAGCGTCTGCACCAGG | 1 | 2 | 36 | SEQ ID NO. 3814 |
| (N20)NGG | 8 | 48801637 | – | ATGTTGAAACCTATGCTTGCGG | 1 | 1 | 23 | SEQ ID NO. 3815 |
| (N20)NGG | 8 | 48801638 | – | GATGTTGAAACCTATGCTTGCGG | 1 | 4 | 17 | SEQ ID NO. 3816 |
| (N20)NGG | 8 | 48801669 | – | CAGGAAGATGAGCCATAACCTGG | 2 | 8 | 38 | SEQ ID NO. 3817 |
| (N20)NGG | 8 | 48801688 | – | ATCAGATTCACACAACATCAGG | 2 | 4 | 70 | SEQ ID NO. 3818 |
| (N20)NGG | 8 | 48801728 | – | CTCTAGGATATCTTTGTATGGGG | 1 | 1 | 35 | SEQ ID NO. 3819 |
| (N20)NGG | 8 | 48801729 | – | TCTCTAGGATATCTTTGTATGG | 1 | 7 | 60 | SEQ ID NO. 3820 |
| (N20)NGG | 8 | 48801730 | – | GTCTCTAGGATATCTTTGTATGG | 1 | 2 | 32 | SEQ ID NO. 3821 |
| (N20)NGG | 8 | 48801744 | – | TCTCTCTCAGATGGGTCTCTAGG | 1 | 1 | 39 | SEQ ID NO. 3822 |
| (N20)NGG | 8 | 48801752 | – | TGTTATTTTCTCTCTCAGATGG | 1 | 13 | 157 | SEQ ID NO. 3823 |
| (N20)NGG | 8 | 48801753 | – | CTGTTATTTTCTCTCTCAGATGG | 3 | 13 | 162 | SEQ ID NO. 3824 |
| (N20)NGG | 8 | 48802817 | + | ACTTTAATATAATTGCTTCTAGG | 3 | 18 | 179 | SEQ ID NO. 3825 |
| (N20)NGG | 8 | 48802852 | + | GTCTTCACTTTTGAAAGCAGTGG | 1 | 5 | 82 | SEQ ID NO. 3826 |
| (N20)NGG | 8 | 48802910 | + | ATAGCAGCAGAAAAGTGCTTTGG | 2 | 5 | 105 | SEQ ID NO. 3827 |
| (N20)NCC | 8 | 48802916 | + | GCCAGAAAAGTGCTTTGGCACTGG | 1 | 1 | 30 | SEQ ID NO. 3828 |
| (N20)NGG | 8 | 48802917 | + | CAGAAAAGTGCTTTGGCACTGGG | 1 | 3 | 49 | SEQ ID NO. 3829 |
| (N20)NGG | 8 | 48802918 | + | AGAAAAGTGCTTTGGCACTGGGG | 2 | 4 | 61 | SEQ ID NO. 3830 |
| (N20)NGG | 8 | 48802925 | + | TGCTTTGGCACTGGGCAGCAGG | 2 | 5 | 51 | SEQ ID NO. 3831 |
| (N20)NGG | 8 | 48802948 | + | TAACAGAACAAGCCCACAAGAGG | 1 | 3 | 40 | SEQ ID NO. 3832 |
| (N20)NGG | 8 | 48802949 | + | AACAGAACAAGCCCACAAGAGGG | 1 | 4 | 62 | SEQ ID NO. 3833 |
| (N20)NGG | 8 | 48802956 | + | CAAGCCCACAAGAGGGAGAAAGG | 1 | 5 | 71 | SEQ ID NO. 3834 |
| (N20)NGG | 8 | 48802984 | + | CTACAGCAAATGCACCGTTGTGG | 1 | 2 | 8 | SEQ ID NO. 3835 |
| (N20)NGG | 8 | 48802989 | + | GCAAATGCACCGTTGTGTCCGG | 1 | 1 | 13 | SEQ ID NO. 3836 |

FIG. 12 cont.

| site_type | site_chromosome | site_start_nucleotide | site_strand | target_site_sequence_with NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48802996 | + | CACCGTTGTGGTCCGGATTATGG | 1 | 2 | 4 | SEQ ID NO. 3837 |
| (N20)NGG | 8 | 48803029 | + | GACTCTGCTAAACACCTCCCCGG | 1 | 2 | 27 | SEQ ID NO. 3838 |
| (N20)NGG | 8 | 48803033 | + | CTGCTAAACACCTCCCCGAAGG | 1 | 1 | 15 | SEQ ID NO. 3839 |
| (N20)NGG | 8 | 48803037 | + | TAAACACCTCCCCGAAGGATGG | 1 | 1 | 35 | SEQ ID NO. 3840 |
| (N20)NGG | 8 | 48803041 | + | CACCTCCCCGAAGGATGGAAGG | 1 | 1 | 31 | SEQ ID NO. 3841 |
| (N20)NGG | 8 | 48803045 | + | TCCCCGAAGGATGGAAGGTAGG | 1 | 2 | 29 | SEQ ID NO. 3842 |
| (N20)NGG | 8 | 48803064 | + | TAGGCTGCTCTGTTAATTTGAGG | 1 | 3 | 32 | SEQ ID NO. 3843 |
| (N20)NGG | 8 | 48802826 | – | TGCTTTCAAAAGTGAAGACTGGG | 1 | 8 | 102 | SEQ ID NO. 3844 |
| (N20)NGG | 8 | 48802827 | – | CTGCTTTCAAAAGTGAAGACTGG | 1 | 2 | 82 | SEQ ID NO. 3845 |
| (N20)NGG | 8 | 48802874 | – | TGCTGCTATAATGTCATGCATGG | 1 | 1 | 57 | SEQ ID NO. 3846 |
| (N20)NGG | 8 | 48802938 | – | TGTACCTTTCTCCCCTCTTGTGG | 1 | 5 | 80 | SEQ ID NO. 3847 |
| (N20)NGG | 8 | 48802939 | – | TTGTACCTTTCTCCCCTCTTGTG | 1 | 6 | 82 | SEQ ID NO. 3848 |
| (N20)NGG | 8 | 48802976 | – | CTCCATAATCCGGACCACAACGG | 1 | 1 | 8 | SEQ ID NO. 3849 |
| (N20)NGG | 8 | 48802986 | – | TCGTGGTAAACTCCATAATCCGG | 1 | 2 | 10 | SEQ ID NO. 3850 |
| (N20)NGG | 8 | 48803003 | – | GGAGGTGTTTAGCAGAGTCCTGG | 1 | 1 | 16 | SEQ ID NO. 3851 |
| (N20)NGG | 8 | 48803021 | – | TACCTTCCATCCTTCCGGGAGG | 1 | 1 | 18 | SEQ ID NO. 3852 |
| (N20)NGG | 8 | 48803024 | – | GCCTACCTTCCATCCTTCCGGGG | 1 | 2 | 25 | SEQ ID NO. 3853 |
| (N20)NGG | 8 | 48803025 | – | AGCCTACCTTCCATCCTTCCGGG | 1 | 11 | 84 | SEQ ID NO. 3854 |
| (N20)NGG | 8 | 48803026 | – | CAGCCTACCTTCCATCCTTCCGG | 1 | 6 | 71 | SEQ ID NO. 3855 |
| (N20)NGG | 8 | 48805699 | + | TTAATTTGTTTCTTTTTAAAGG | 6 | 183 | 2613 | SEQ ID NO. 3856 |
| (N20)NGG | 8 | 48805721 | + | GCAACAGATCCCCTAATTTGTGG | 1 | 4 | 25 | SEQ ID NO. 3857 |
| (N20)NGG | 8 | 48805740 | + | GTGGCTGAAAGATGTTCTCAAGG | 1 | 2 | 48 | SEQ ID NO. 3858 |
| (N20)NGG | 8 | 48805747 | + | AAAGATGTTCTCAAGGAAGAAGG | 1 | 8 | 138 | SEQ ID NO. 3859 |
| (N20)NGG | 8 | 48805776 | + | TTTTCTCATCAACACCTTTGAGG | 2 | 7 | 90 | SEQ ID NO. 3860 |
| (N20)NGG | 8 | 48805777 | + | TTTCTCATCAACACCTTTGAGGG | 1 | 7 | 88 | SEQ ID NO. 3861 |
| (N20)NGG | 8 | 48805778 | + | TTCTCATCAACACCTTTGAGGGG | 1 | 3 | 53 | SEQ ID NO. 3862 |
| (N20)NGG | 8 | 48805779 | + | TCTCATCAACACCTTTGAGGGGG | 1 | 3 | 41 | SEQ ID NO. 3863 |
| (N20)NGG | 8 | 48805780 | + | CTCATCAACACCTTTGAGGGGGG | 2 | 5 | 35 | SEQ ID NO. 3864 |
| (N20)NGG | 8 | 48805783 | + | ATCAACACCTTTGAGGGGGGTGG | 1 | 4 | 32 | SEQ ID NO. 3865 |
| (N20)NGG | 8 | 48805789 | + | ACCTTTGAGGGGGTGGCTGTGG | 1 | 3 | 51 | SEQ ID NO. 3866 |
| (N20)NGG | 8 | 48805800 | + | GGGTGGCTGTGGCCAGCCCTCGG | 3 | 11 | 127 | SEQ ID NO. 3867 |
| (N20)NGG | 8 | 48805801 | + | GGTGGCTGTGGCCAGCCCTCGGG | 2 | 8 | 104 | SEQ ID NO. 3868 |
| (N20)NGG | 8 | 48805809 | + | TGGCCAGCCCTCGGGCATCCTG | 2 | 3 | 38 | SEQ ID NO. 3869 |

FIG. 12 cont.

| site_type | site_chr omosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48805834 | + | CAGCCCACCCTCTTGTACTTCGG | 2 | 3 | 34 | SEQ ID NO. 3870 |
| (N20)NGG | 8 | 48805835 | + | AGCCCACCCTCTTGTACTTCGGG | 1 | 1 | 23 | SEQ ID NO. 3871 |
| (N20)NGG | 8 | 48805836 | + | GCCCACCCTCTTGTACTTCGGGG | 1 | 2 | 22 | SEQ ID NO. 3872 |
| (N20)NGG | 8 | 48805837 | + | CCCACCCTCTTGTACTTCGGGGG | 1 | 2 | 27 | SEQ ID NO. 3873 |
| (N20)NGG | 8 | 48805853 | + | TCGGGGCCATTCAGCCTGCAGG | 1 | 1 | 12 | SEQ ID NO. 3874 |
| (N20)NGG | 8 | 48805867 | + | GCCTGCAGGCCACGCTATGCTGG | 1 | 1 | 36 | SEQ ID NO. 3875 |
| (N20)NGG | 8 | 48805871 | + | GCAGGCCACGCTATGCTGGCTGG | 1 | 1 | 10 | SEQ ID NO. 3876 |
| (N20)NGG | 8 | 48805883 | + | ATGCTGGCTGGACCTGCTCCTGG | 1 | 5 | 48 | SEQ ID NO. 3877 |
| (N20)NGG | 8 | 48805892 | + | GGACCTGCTCCTGGCCGCGTTGG | 1 | 1 | 17 | SEQ ID NO. 3878 |
| (N20)NGG | 8 | 48805914 | + | GAGTGCTACAACACGTTCATTGG | 1 | 1 | 10 | SEQ ID NO. 3879 |
| (N20)NGG | 8 | 48805929 | + | TTCATTGGCGAGAGAACTGTAGG | 1 | 3 | 16 | SEQ ID NO. 3880 |
| (N20)NGG | 8 | 48805940 | + | GAGAACTGTAGGAGCGCTCCAGG | 1 | 1 | 9 | SEQ ID NO. 3881 |
| (N20)NGG | 8 | 48805947 | + | GTAGGAGCGCTCCAGGTCCTAGG | 1 | 1 | 16 | SEQ ID NO. 3882 |
| (N20)NGG | 8 | 48805951 | + | GAGCGCTCCAGGTCCTAGGTAGG | 1 | 2 | 15 | SEQ ID NO. 3883 |
| (N20)NGG | 8 | 48805971 | + | AGGTCACCCTTGCCTTATTCTGG | 1 | 6 | 87 | SEQ ID NO. 3884 |
| (N20)NGG | 8 | 48805708 | - | ATCTTTCAGCCACCACAAATTAGGG | 2 | 6 | 56 | SEQ ID NO. 3885 |
| (N20)NGG | 8 | 48805709 | - | CATCTTTCAGCCACCACAAATTAGG | 2 | 5 | 53 | SEQ ID NO. 3886 |
| (N20)NGG | 8 | 48805710 | - | ACATCTTTCAGCCACCACAAAGG | 1 | 4 | 58 | SEQ ID NO. 3887 |
| (N20)NGG | 8 | 48805768 | - | GCCACAGCCACCCCCGAGGGCTGG | 2 | 2 | 67 | SEQ ID NO. 3888 |
| (N20)NGG | 8 | 48805790 | - | GGGCCAGGATGCCCAGGAGGGCTGG | 2 | 6 | 61 | SEQ ID NO. 3889 |
| (N20)NGG | 8 | 48805794 | - | GGCTGGGCCAGGATGCCCGAGG | 1 | 2 | 45 | SEQ ID NO. 3890 |
| (N20)NGG | 8 | 48805795 | - | GGGCTGGGCCAGGATGCCCCAGG | 1 | 8 | 103 | SEQ ID NO. 3891 |
| (N20)NGG | 8 | 48805805 | - | ACAAGAGGGTGGCTGGGCCAGG | 2 | 12 | 157 | SEQ ID NO. 3892 |
| (N20)NGG | 8 | 48805810 | - | GAAGTACAAGAGGGTGGGCTGG | 2 | 5 | 49 | SEQ ID NO. 3893 |
| (N20)NGG | 8 | 48805811 | - | CGAAGTACAAGAGGGTGGGCTGG | 1 | 2 | 27 | SEQ ID NO. 3894 |
| (N20)NGG | 8 | 48805815 | - | CCCCGAAGTACAAGAGGGTGGG | 1 | 1 | 5 | SEQ ID NO. 3895 |
| (N20)NGG | 8 | 48805816 | - | CCCCCGAAGTACAAGAGGGTGG | 1 | 1 | 9 | SEQ ID NO. 3896 |
| (N20)NGG | 8 | 48805819 | - | ATGGCCCCGAAGTACAAGAGG | 1 | 1 | 14 | SEQ ID NO. 3897 |
| (N20)NGG | 8 | 48805820 | - | AATGGCCCCGAAGTACAAGAG | 1 | 1 | 13 | SEQ ID NO. 3898 |
| (N20)NGG | 8 | 48805838 | - | AGCGTGGCCTGCAGGCTGAATGG | 1 | 2 | 29 | SEQ ID NO. 3899 |
| (N20)NGG | 8 | 48805846 | - | GCCAGCATAGCGTGGCCTGCAGG | 1 | 3 | 22 | SEQ ID NO. 3900 |
| (N20)NGG | 8 | 48805854 | - | CAGGTCCAGCCAGCATAGCGTGG | 1 | 1 | 17 | SEQ ID NO. 3901 |
| (N20)NGG | 8 | 48805873 | - | ACTCCAACGCGGCCAGGAGCAGG | 1 | 1 | 16 | SEQ ID NO. 3902 |

| site type | site chromosome | site_start nucleotide | site strand | target_site_sequence_with NGG | genome wide hits with 1 or less mismatches | genome wide hits with 2 or less mismatches | genome wide hits with 3 or less mismatches | | |
|---|---|---|---|---|---|---|---|---|---|
| (N20)NGG | 8 | 48805879 | - | TGTAGCACTCCAACGCGGCCAGG | 1 | 1 | 6 | SEQ ID NO. | 3903 |
| (N20)NGG | 8 | 48805884 | - | CGTGTTGTAGCACTCCAACGCGG | 1 | 1 | 8 | SEQ ID NO. | 3904 |
| (N20)NGG | 8 | 48805936 | - | AGGGTGACCTACCTAGGACCTGG | 1 | 1 | 11 | SEQ ID NO. | 3905 |
| (N20)NGG | 8 | 48805942 | - | AAGGCAAGGTGACCTACCTAGG | 1 | 1 | 24 | SEQ ID NO. | 3906 |
| (N20)NGG | 8 | 48809722 | + | AGTATGCTGTCTCTGTGCAGAGG | 1 | 2 | 56 | SEQ ID NO. | 3907 |
| (N20)NGG | 8 | 48809754 | + | TTCCGCATCATTGTGTTTATTGG | 1 | 1 | 28 | SEQ ID NO. | 3908 |
| (N20)NGG | 8 | 48809760 | + | ATCATTGTGTTTATTGGATCTGG | 1 | 3 | 46 | SEQ ID NO. | 3909 |
| (N20)NGG | 8 | 48809768 | + | GTTTATTGGATCTGGTCAAGTGG | 1 | 2 | 25 | SEQ ID NO. | 3910 |
| (N20)NGG | 8 | 48809785 | + | AAGTGGCTTTTAGCTCATTGTGG | 1 | 1 | 31 | SEQ ID NO. | 3911 |
| (N20)NGG | 8 | 48809786 | + | AGTGGCTTTTAGCTCATTGTGGG | 1 | 1 | 36 | SEQ ID NO. | 3912 |
| (N20)NGG | 8 | 48809789 | + | GGCTTTTAGCTCATTGTGGGAGG | 1 | 1 | 28 | SEQ ID NO. | 3913 |
| (N20)NGG | 8 | 48809854 | + | AAATTCGTTCCTTTATTGCCAGG | 1 | 3 | 34 | SEQ ID NO. | 3914 |
| (N20)NGG | 8 | 48809859 | + | CGTTCCTTTATTGCCAGGTATGG | 1 | 1 | 14 | SEQ ID NO. | 3915 |
| (N20)NGG | 8 | 48809727 | - | AAACACAATGATGCGGAAGGTGG | 1 | 2 | 25 | SEQ ID NO. | 3916 |
| (N20)NGG | 8 | 48809730 | - | AATAAACACAATGATGCGGAAGG | 1 | 2 | 31 | SEQ ID NO. | 3917 |
| (N20)NGG | 8 | 48809734 | - | ATCCAATAAACACAATGATGCGG | 1 | 1 | 59 | SEQ ID NO. | 3918 |
| (N20)NGG | 8 | 48809790 | - | TTGTGTCGACATTCTGTCTGGGG | 1 | 3 | 47 | SEQ ID NO. | 3919 |
| (N20)NGG | 8 | 48809791 | - | TTTGTGTCGACATTCTGTCTGGG | 1 | 1 | 31 | SEQ ID NO. | 3920 |
| (N20)NGG | 8 | 48809792 | - | ATTTGTGTCGACATTCTGTCTGG | 1 | 1 | 16 | SEQ ID NO. | 3921 |
| (N20)NGG | 8 | 48809815 | - | GAATTTATAAAAGAGTTCAATGG | 1 | 5 | 162 | SEQ ID NO. | 3922 |
| (N20)NGG | 8 | 48809841 | - | ATTACCATACCTGGCAATAAAGG | 1 | 5 | 55 | SEQ ID NO. | 3923 |
| (N20)NGG | 8 | 48809850 | - | GATATACAGATTACCATACCTGG | 1 | 3 | 19 | SEQ ID NO. | 3924 |
| (N20)NGG | 8 | 48811029 | + | ATGTCTCTGTACTTGAGAACAGG | 1 | 5 | 46 | SEQ ID NO. | 3925 |
| (N20)NGG | 8 | 48811129 | + | CAAAGAAACGACGTTTGCCGCGG | 1 | 2 | 6 | SEQ ID NO. | 3926 |
| (N20)NGG | 8 | 48811133 | + | GAAACGACGTTTGCCGCGGTAGG | 1 | 1 | 1 | SEQ ID NO. | 3927 |
| (N20)NGG | 8 | 48811053 | - | GATGCGGCATAGGTGATCAATGG | 1 | 1 | 13 | SEQ ID NO. | 3928 |
| (N20)NGG | 8 | 48811063 | - | TCTTTTCAATGATGCGGCATAGG | 1 | 4 | 22 | SEQ ID NO. | 3929 |
| (N20)NGG | 8 | 48811069 | - | CATGCTTCTTTTCAATGATGCGG | 1 | 1 | 58 | SEQ ID NO. | 3930 |
| (N20)NGG | 8 | 48811124 | - | GGAAGCAAGATCACCTACCGCGG | 1 | 1 | 18 | SEQ ID NO. | 3931 |
| (N20)NGG | 8 | 48812932 | + | TTTCCTATTCTTTATTTTACAGG | 2 | 25 | 352 | SEQ ID NO. | 3932 |
| (N20)NGG | 8 | 48812933 | + | TTCCTATTCTTTATTTTACAGGG | 2 | 12 | 304 | SEQ ID NO. | 3933 |
| (N20)NGG | 8 | 48812948 | + | TTACAGGGAAGAAGAGTCTCTGG | 1 | 3 | 52 | SEQ ID NO. | 3934 |
| (N20)NGG | 8 | 48812951 | + | CAGGGAAGAAGAGTCTCTGGTGG | 1 | 7 | 112 | SEQ ID NO. | 3935 |

| site_type | site_chr omosome | site_start_ nucleotide | site_s trand | target_site_sequence wi th NGG | genome_wide_ hits_with_1 or_less_mism atches | genome_wide_ hits_with_ 2_or_less_m ismatches | genome_wide_ hits_with_3 or_less_mism atches | | |
|---|---|---|---|---|---|---|---|---|---|
| (N20)NGG | 8 | 48812975 | + | ACAGTTTGTGTTTGAAGCCTTGG | 1 | | 6 | 56 | SEQ ID NO. 3936 |
| (N20)NGG | 8 | 48812987 | + | TGAAGCCTTGGTGATATACATGG | 1 | | 2 | 33 | SEQ ID NO. 3937 |
| (N20)NGG | 8 | 48812996 | + | GGTGATATACATGGAGAGTCTGG | 1 | | 1 | 11 | SEQ ID NO. 3938 |
| (N20)NGG | 8 | 48813027 | + | CATGCAGATGAGAAGTCCTTAGG | 1 | | 2 | 55 | SEQ ID NO. 3939 |
| (N20)NGG | 8 | 48812913 | - | TTCCCTGTAAATAAAGAATAGG | 2 | | 16 | 246 | SEQ ID NO. 3940 |
| (N20)NGG | 8 | 48812970 | - | ACTCTCCATGTATATCACCAAGG | 1 | | 1 | 24 | SEQ ID NO. 3941 |
| (N20)NGG | 8 | 48812997 | - | CTTCCATCTGCATGTGCTAAGG | 1 | | 2 | 63 | SEQ ID NO. 3942 |
| (N20)NGG | 8 | 48813021 | - | ACTGAAGCAAAACGTACCTAAGG | 1 | | 1 | 25 | SEQ ID NO. 3943 |
| (N20)NGG | 8 | 48815128 | + | AGGTCTCTTTGTTTGTTTCAGG | 1 | | 15 | 192 | SEQ ID NO. 3944 |
| (N20)NGG | 8 | 48815132 | + | CTCTTTGTTTGTTTCAGGATGG | 1 | | 11 | 201 | SEQ ID NO. 3945 |
| (N20)NGG | 8 | 48815140 | + | TTTGTTTCAGGATGGAATTGTGG | 1 | | 4 | 85 | SEQ ID NO. 3946 |
| (N20)NGG | 8 | 48815174 | + | AGTACTTTAAGAGATTTTTGTGG | 2 | | 7 | 119 | SEQ ID NO. 3947 |
| (N20)NGG | 8 | 48815178 | + | CTTTAAGAGATTTTTGTGGTCGG | 1 | | 7 | 99 | SEQ ID NO. 3948 |
| (N20)NGG | 8 | 48815202 | + | GTATTCGAGAATTCCTTAAATGG | 1 | | 2 | 18 | SEQ ID NO. 3949 |
| (N20)NGG | 8 | 48815233 | + | GCAAATAACACCACAGCAGCAGG | 1 | | 3 | 39 | SEQ ID NO. 3950 |
| (N20)NGG | 8 | 48815310 | + | TTCACCCCAATGCTTTCAAGAGG | 1 | | 2 | 40 | SEQ ID NO. 3951 |
| (N20)NGG | 8 | 48815314 | + | CCCCAATGCTTTCAAGAGGCTGG | 1 | | 3 | 23 | SEQ ID NO. 3952 |
| (N20)NGG | 8 | 48815315 | + | CCCAATGCTTTCAAGAGGCTGGG | 1 | | 2 | 56 | SEQ ID NO. 3953 |
| (N20)NGG | 8 | 48815346 | + | TTGCCTTTAATAATATCTACAGG | 1 | | 5 | 70 | SEQ ID NO. 3954 |
| (N20)NGG | 8 | 48815347 | + | TGCCTTTAATAATATCTACAGGG | 1 | | 5 | 105 | SEQ ID NO. 3955 |
| (N20)NGG | 8 | 48815355 | + | ATAATATCTACAGGGAATTCAGG | 1 | | 4 | 53 | SEQ ID NO. 3956 |
| (N20)NGG | 8 | 48815142 | - | CTCTTAAAGTACTGTCAACAGG | 1 | | 3 | 40 | SEQ ID NO. 3957 |
| (N20)NGG | 8 | 48815143 | - | TCTCTTAAAGTACTGTCAACAGG | 1 | | 3 | 27 | SEQ ID NO. 3958 |
| (N20)NGG | 8 | 48815193 | - | TTTGCTTAATGGACCATTTAAGG | 1 | | 4 | 43 | SEQ ID NO. 3959 |
| (N20)NGG | 8 | 48815204 | - | CTGTGGTGTTATTTGCTTAATGG | 2 | | 4 | 63 | SEQ ID NO. 3960 |
| (N20)NGG | 8 | 48815221 | - | GGACTCTTCCTCCTGCTGCTGTGG | 1 | | 9 | 70 | SEQ ID NO. 3961 |
| (N20)NGG | 8 | 48815242 | - | AAAAGCGATTTGGTGTTTACTGG | 1 | | 2 | 23 | SEQ ID NO. 3962 |
| (N20)NGG | 8 | 48815252 | - | AAGTCGCTTGAAAAGCGATTTGG | 1 | | 1 | 6 | SEQ ID NO. 3963 |
| (N20)NGG | 8 | 48815280 | - | AAGCATTGGGGTGAAGCGCAAGG | 1 | | 1 | 20 | SEQ ID NO. 3964 |
| (N20)NGG | 8 | 48815292 | - | CCAGCCTCTTGAAAGCATTGGG | 1 | | 2 | 39 | SEQ ID NO. 3965 |
| (N20)NGG | 8 | 48815293 | - | CCCAGCCTCTTGAAAGCATTGG | 1 | | 5 | 60 | SEQ ID NO. 3966 |
| (N20)NGG | 8 | 48815294 | - | TCCCAGCCTCTTGAAAGCATTGG | 2 | | 5 | 147 | SEQ ID NO. 3967 |
| (N20)NGG | 8 | 48815327 | - | TTCCCTGTAGATATTATTAAAGG | 1 | | 6 | 82 | SEQ ID NO. 3968 |

FIG. 12 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48817428 | + | TTTAATGGTATTGTTTCTTCAGG | 2 | 61 | 604 | SEQ ID NO. 3969 |
| (N20)NGG | 8 | 48817436 | + | TATTGTTTCTTCAGTGACAAGG | 1 | 1 | 63 | SEQ ID NO. 3970 |
| (N20)NGG | 8 | 48817475 | + | TAGTTATGCAGCTGATTCACTGG | 1 | 2 | 13 | SEQ ID NO. 3971 |
| (N20)NGG | 8 | 48817506 | + | CAACAAGAAATTTGAAAGTCAGG | 1 | 4 | 108 | SEQ ID NO. 3972 |
| (N20)NGG | 8 | 48817536 | + | TGCCTTACTAGAAGCTATATTGG | 1 | 3 | 16 | SEQ ID NO. 3973 |
| (N20)NGG | 8 | 48817449 | - | TGAATCAGCTGCATAACTAGTGG | 1 | 2 | 35 | SEQ ID NO. 3974 |
| (N20)NGG | 8 | 48817516 | - | TACCAATATAGCTTCTAGTAAGG | 1 | 1 | 16 | SEQ ID NO. 3975 |
| (N20)NGG | 8 | 48824969 | + | CTGACCTCCTGGTCTGTTTTAGG | 1 | 4 | 54 | SEQ ID NO. 3976 |
| (N20)NGG | 8 | 48824999 | + | CTGTGAACTTTTACATAGCATGG | 1 | 3 | 50 | SEQ ID NO. 3977 |
| (N20)NGG | 8 | 48825014 | + | TAGCATGGTTATGTTTATGTTGG | 1 | 2 | 59 | SEQ ID NO. 3978 |
| (N20)NGG | 8 | 48825015 | + | AGCATGGTTATGTTTATGTTTGG | 1 | 3 | 54 | SEQ ID NO. 3979 |
| (N20)NGG | 8 | 48825039 | + | AAAGCCACGCAGATGCCAGAAGG | 1 | 5 | 55 | SEQ ID NO. 3980 |
| (N20)NGG | 8 | 48825040 | + | AAGCCACGCAGATGCCAGAAGGG | 1 | 4 | 72 | SEQ ID NO. 3981 |
| (N20)NGG | 8 | 48825041 | + | AGCCACGCAGATGCCAGAAGGGG | 1 | 4 | 67 | SEQ ID NO. 3982 |
| (N20)NGG | 8 | 48825042 | + | GCCACGCAGATGCCAGAAGGGGG | 1 | 4 | 46 | SEQ ID NO. 3983 |
| (N20)NGG | 8 | 48825047 | + | GCAGATGCCAGAAGGGGGACAGG | 1 | 3 | 57 | SEQ ID NO. 3984 |
| (N20)NGG | 8 | 48825048 | + | CAGATGCCAGAAGGGGGACAGGG | 2 | 5 | 71 | SEQ ID NO. 3985 |
| (N20)NGG | 8 | 48825079 | + | CCATGTACCAGCTCTATAAGCGG | 1 | 3 | 21 | SEQ ID NO. 3986 |
| (N20)NGG | 8 | 48825122 | + | ACTTGCGTGTGATGTTGATCAGG | 1 | 2 | 11 | SEQ ID NO. 3987 |
| (N20)NGG | 8 | 48825127 | + | CGTGTGATGTTGATCAGGTAAGG | 1 | 2 | 7 | SEQ ID NO. 3988 |
| (N20)NGG | 8 | 48825128 | + | GTGTGATGTTGATCAGGTAAGGG | 1 | 2 | 30 | SEQ ID NO. 3989 |
| (N20)NGG | 8 | 48824951 | - | GCAACCTAAAACAGACCAGGAGG | 1 | 3 | 25 | SEQ ID NO. 3990 |
| (N20)NGG | 8 | 48824954 | - | GCTGCAACCTAAAACAGACCAGG | 1 | 3 | 23 | SEQ ID NO. 3991 |
| (N20)NGG | 8 | 48824976 | - | CATGCTATGTAAAAGTTCACAGG | 1 | 4 | 51 | SEQ ID NO. 3992 |
| (N20)NGG | 8 | 48825021 | - | TCCCCCTTCTGGCATCTGCGTGG | 1 | 2 | 22 | SEQ ID NO. 3993 |
| (N20)NGG | 8 | 48825032 | - | GGGCTCCCTGTCCCCCTTCTGG | 1 | 5 | 68 | SEQ ID NO. 3994 |
| (N20)NGG | 8 | 48825051 | - | ATAGAGCTGGTACATGGGTGGG | 1 | 1 | 24 | SEQ ID NO. 3995 |
| (N20)NGG | 8 | 48825052 | - | TATAGAGCTGGTACATGGGTGG | 1 | 2 | 22 | SEQ ID NO. 3996 |
| (N20)NGG | 8 | 48825053 | - | TTATAGAGCTGGTACATGGGTGG | 1 | 1 | 20 | SEQ ID NO. 3997 |
| (N20)NGG | 8 | 48825056 | - | CGCTTATAGAGCTGGTACATGGG | 1 | 1 | 7 | SEQ ID NO. 3998 |
| (N20)NGG | 8 | 48825057 | - | CCGTTATAGAGCTGGTACATGG | 1 | 1 | 4 | SEQ ID NO. 3999 |
| (N20)NGG | 8 | 48825064 | - | GAAACTCCGCTTATAGAGCTGG | 1 | 1 | 2 | SEQ ID NO. 4000 |
| (N20)NGG | 8 | 48825086 | - | CACGCAAGTCGAAGCAGCACAGG | 1 | 2 | 8 | SEQ ID NO. 4001 |

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48826495 | + | TGAGATGATGAAGAGCTATGTGG | 1 | 1 | 11 | 69 SEQ ID NO. 4002 |
| (N20)NGG | 8 | 48826500 | + | TGATGAAGAGCTATGTGGCCTGG | 1 | 1 | 1 | 39 SEQ ID NO. 4003 |
| (N20)NGG | 8 | 48826501 | + | GATGAAGAGCTATGTGGCCTGGG | 1 | 8 | 8 | 59 SEQ ID NO. 4004 |
| (N20)NGG | 8 | 48826515 | + | TGGCCTGGGACAGAGAAGCGG | 2 | 9 | 9 | 195 SEQ ID NO. 4005 |
| (N20)NGG | 8 | 48826564 | + | GATGAAACCTGTCATTTTCCTGG | 1 | 5 | 5 | 54 SEQ ID NO. 4006 |
| (N20)NGG | 8 | 48826466 | − | GCTCTTCATCATCTCATCTGAGG | 2 | 3 | 3 | 57 SEQ ID NO. 4007 |
| (N20)NGG | 8 | 48826496 | − | CAGCCGCTTCTCTCTGTCCAGG | 2 | 10 | 10 | 95 SEQ ID NO. 4008 |
| (N20)NGG | 8 | 48826531 | − | ACAGGTTTCATCTCTCTAAAGG | 1 | 4 | 4 | 54 SEQ ID NO. 4009 |
| (N20)NGG | 8 | 48826532 | − | GACAGGTTTCATCTCTCTAAGG | 1 | 6 | 6 | 34 SEQ ID NO. 4010 |
| (N20)NGG | 8 | 48826549 | − | AACACATCCAGAAAATGACAGG | 1 | 5 | 5 | 92 SEQ ID NO. 4011 |
| (N20)NGG | 8 | 48826560 | − | CTCGAGGCAGGAACACATCCAGG | 1 | 2 | 2 | 33 SEQ ID NO. 4012 |
| (N20)NGG | 8 | 48826572 | − | CTAATTCTGTGACTGCGAGGCAGG | 1 | 1 | 1 | 50 SEQ ID NO. 4013 |
| (N20)NGG | 8 | 48826576 | − | AGCGCTAATTCTGTGACTCGAGG | 1 | 2 | 2 | 7 SEQ ID NO. 4014 |
| (N20)NGG | 8 | 48826604 | − | TACTTTAGTTTGTCTGTCACTGG | 1 | 1 | 1 | 37 SEQ ID NO. 4015 |
| (N20)NGG | 8 | 48827939 | + | ATTAGAGTAGTACAAATGCTTGG | 1 | 2 | 2 | 32 SEQ ID NO. 4016 |
| (N20)NGG | 8 | 48827948 | + | GTACAAATGCTTGGATCTCTAGG | 1 | 4 | 4 | 29 SEQ ID NO. 4017 |
| (N20)NGG | 8 | 48827951 | + | CAAATGCTTGGATCTCTAGGAGG | 1 | 10 | 10 | 204 SEQ ID NO. 4018 |
| (N20)NGG | 8 | 48827978 | + | ATAAACAAAAATCTTCTGACAGG | 1 | 8 | 8 | 137 SEQ ID NO. 4019 |
| (N20)NGG | 8 | 48827990 | − | TCTAATTCTTATTCTTCTAAGG | 2 | 22 | 22 | 266 SEQ ID NO. 4020 |
| (N20)NGG | 8 | 48830855 | + | TAGATGAGACCAAGAATAACTGG | 1 | 2 | 2 | 47 SEQ ID NO. 4021 |
| (N20)NGG | 8 | 48830856 | + | AGATGAGACCAAGAATAACTGGG | 1 | 6 | 6 | 61 SEQ ID NO. 4022 |
| (N20)NGG | 8 | 48830876 | + | GGGAAGTGTCAGCTCTTTCTCGG | 1 | 6 | 6 | 57 SEQ ID NO. 4023 |
| (N20)NGG | 8 | 48830877 | + | GGAAGTGTCAGCTCTTTCTCGGG | 1 | 4 | 4 | 50 SEQ ID NO. 4024 |
| (N20)NGG | 8 | 48830890 | + | CTTTCTCGGGCTGCCCAGAAAGG | 1 | 5 | 5 | 36 SEQ ID NO. 4025 |
| (N20)NGG | 8 | 48830904 | + | CCAGAAAGGATTTAATAAAGTGG | 1 | 5 | 5 | 118 SEQ ID NO. 4026 |
| (N20)NGG | 8 | 48830842 | − | TGACACTTCCCAGTTATTCTTGG | 1 | 1 | 1 | 42 SEQ ID NO. 4027 |
| (N20)NGG | 8 | 48830881 | − | CACTTTATTAAATCCTTTCTGGG | 2 | 5 | 5 | 135 SEQ ID NO. 4028 |
| (N20)NGG | 8 | 48830882 | − | CCACTTTATTAAATCCTTTCTGG | 1 | 7 | 7 | 63 SEQ ID NO. 4029 |
| (N20)NGG | 8 | 48830933 | − | AAGGACTTCTTACTGATGAAAGG | 1 | 7 | 7 | 51 SEQ ID NO. 4030 |
| (N20)NGG | 8 | 48839756 | + | TGTTTGTATTAACATACAGATGG | 1 | 7 | 7 | 123 SEQ ID NO. 4031 |
| (N20)NGG | 8 | 48839768 | + | CATACAGATGGCTTTCAAACTGG | 1 | 2 | 2 | 36 SEQ ID NO. 4032 |
| (N20)NGG | 8 | 48839769 | + | ATACAGATGGCTTTCAAACTGGG | 1 | 4 | 4 | 66 SEQ ID NO. 4033 |
| (N20)NGG | 8 | 48839789 | + | GGGCCTGAGCTATACCCCTTGG | 1 | 4 | 4 | 20 SEQ ID NO. 4034 |

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48839799 | + | TATACCCCTTGGCAGAAGTAGG | | 1 | 1 | 14 SEQ ID NO. 4035 |
| (N20)NGG | 8 | 48839821 | + | GCCTGAATGCTCTAGAAGAATGG | | 1 | 3 | 32 SEQ ID NO. 4036 |
| (N20)NGG | 8 | 48839882 | + | CAAAGACATTCTCCCCTGCCTGG | | 1 | 2 | 42 SEQ ID NO. 4037 |
| (N20)NGG | 8 | 48839886 | + | GACATTCTCCCCTGCCTGGATGG | | 1 | 6 | 51 SEQ ID NO. 4038 |
| (N20)NGG | 8 | 48839913 | + | CTGAAGACTTCAGCCTTGTCAGG | | 1 | 4 | 39 SEQ ID NO. 4039 |
| (N20)NGG | 8 | 48839770 | - | CTGCCAAGGGGTATAGCTCAGG | | 1 | 2 | 11 SEQ ID NO. 4040 |
| (N20)NGG | 8 | 48839781 | - | CAGGCCTACTTCTGCCAAGGGGG | | 1 | 1 | 33 SEQ ID NO. 4041 |
| (N20)NGG | 8 | 48839782 | - | TCAGGCCTACTTCTGCCAAGGGG | | 1 | 1 | 31 SEQ ID NO. 4042 |
| (N20)NGG | 8 | 48839783 | - | TTCAGGCCTACTTCTGCCAAGG | | 1 | 1 | 28 SEQ ID NO. 4043 |
| (N20)NGG | 8 | 48839784 | - | ATTCAGGCCTACTTCTGCCAAGG | | 1 | 2 | 32 SEQ ID NO. 4044 |
| (N20)NGG | 8 | 48839800 | - | ACCATTCTTCTAGAGCATTCAGG | | 1 | 1 | 30 SEQ ID NO. 4045 |
| (N20)NGG | 8 | 48839852 | - | GGGAGAATGTCTTTGTAATAAGG | | 1 | 5 | 68 SEQ ID NO. 4046 |
| (N20)NGG | 8 | 48839872 | - | TCAGGTATCCATCCAGGCAGGGG | | 1 | 3 | 40 SEQ ID NO. 4047 |
| (N20)NGG | 8 | 48839873 | - | TTCAGGTATCCATCCAGGCAGG | | 1 | 3 | 36 SEQ ID NO. 4048 |
| (N20)NGG | 8 | 48839874 | - | CTTCAGGTATCCATCCAGGCAGG | | 1 | 1 | 23 SEQ ID NO. 4049 |
| (N20)NGG | 8 | 48839878 | - | AAGTCTTCAGGTATCCATCCAGG | | 1 | 2 | 27 SEQ ID NO. 4050 |
| (N20)NGG | 8 | 48839890 | - | CTGACAAGGCTGAAGTCTTCAGG | | 1 | 4 | 37 SEQ ID NO. 4051 |
| (N20)NGG | 8 | 48839904 | - | CTTCTAAACATTACCTGACAAGG | | 1 | 2 | 39 SEQ ID NO. 4052 |
| (N20)NGG | 8 | 48840330 | + | TACTGTCTTCTTTCTTGTTAAGG | | 1 | 12 | 166 SEQ ID NO. 4053 |
| (N20)NGG | 8 | 48840333 | + | TGTCTTCTTTCTTGTTAAGGTGG | | 1 | 7 | 123 SEQ ID NO. 4054 |
| (N20)NGG | 8 | 48840369 | + | GCAGTACAAAGATGAACTTTTGG | | 2 | 3 | 51 SEQ ID NO. 4055 |
| (N20)NGG | 8 | 48840450 | + | AGCCTACGTTCCTGCACTGCAGG | | 1 | 1 | 10 SEQ ID NO. 4056 |
| (N20)NGG | 8 | 48840454 | + | TACGTTCCTGCACTGCAGGTAGG | | 1 | 2 | 15 SEQ ID NO. 4057 |
| (N20)NGG | 8 | 48840370 | - | CAGAGAAAGGTCAAACAAGAGAG | | 1 | 5 | 107 SEQ ID NO. 4058 |
| (N20)NGG | 8 | 48840382 | - | GTGTGCAAGGACAGAAGAAAAGG | | 2 | 7 | 158 SEQ ID NO. 4059 |
| (N20)NGG | 8 | 48840394 | - | TTCAATGATGTTGTGTGGCAAGG | | 1 | 2 | 55 SEQ ID NO. 4060 |
| (N20)NGG | 8 | 48840399 | - | TCGAGTTCAATGATGTTGTGTGG | | 1 | 2 | 9 SEQ ID NO. 4061 |
| (N20)NGG | 8 | 48840430 | - | TACCTGCAGTGCAGGAACGTAGG | | 1 | 1 | 18 SEQ ID NO. 4062 |
| (N20)NGG | 8 | 48840438 | - | ACAACGCCTACCTGCAGTGCAGG | | 1 | 2 | 12 SEQ ID NO. 4063 |
| (N20)NGG | 8 | 48841651 | + | AACTTGCTGTTTATTTGACAGG | | 2 | 10 | 99 SEQ ID NO. 4064 |
| (N20)NGG | 8 | 48841652 | + | ACTTGCTGTTTTATTTGACAGG | | 1 | 7 | 108 SEQ ID NO. 4065 |
| (N20)NGG | 8 | 48841730 | + | TTTGCTTTATTTGTGAAATTTGG | | 1 | 15 | 363 SEQ ID NO. 4066 |
| (N20)NGG | 8 | 48841738 | + | ATTTGTGAAATTTGGCAAAGAGG | | 2 | 13 | 136 SEQ ID NO. 4067 |

FIG. 12 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48841660 | - | GGAGAGTGTTTCAGACTCTTTGG | | 1 | 3 | 33 SEQ ID NO. 4068 |
| (N20)NGG | 8 | 48841681 | - | GAATACTTTTCTGGGTCTTCAGG | | 1 | 7 | 46 SEQ ID NO. 4069 |
| (N20)NGG | 8 | 48841689 | - | CAAAGCAAGAATACTTTTCTGGG | | 2 | 4 | 143 SEQ ID NO. 4070 |
| (N20)NGG | 8 | 48841690 | - | GCAAAGCAAGAATACTTTTCTGG | | 1 | 5 | 62 SEQ ID NO. 4071 |
| (N20)NGG | 8 | 48842454 | + | AAGCAGAATTTTTGAACCATGG | | 2 | 31 | 630 SEQ ID NO. 4072 |
| (N20)NGG | 8 | 48842455 | + | AGCAGAATTTTTGAACCATGGG | | 1 | 3 | 137 SEQ ID NO. 4073 |
| (N20)NGG | 8 | 48842496 | + | AATTAATTTTGCAATCTACAAGG | | 1 | 5 | 116 SEQ ID NO. 4074 |
| (N20)NGG | 8 | 48842513 | + | ACAAGGTTGCCCCTCATCAGTGG | | 1 | 3 | 19 SEQ ID NO. 4075 |
| (N20)NGG | 8 | 48842572 | + | CAAGAAAATAAAATATTTCGAGG | | 1 | 20 | 306 SEQ ID NO. 4076 |
| (N20)NGG | 8 | 48842589 | + | TCGAGGTGAGTCTTTCTTTGCAGG | | 2 | 4 | 38 SEQ ID NO. 4077 |
| (N20)NGG | 8 | 48842421 | - | AAAAATTCTGCTTGTTTCTCAGG | | 1 | 13 | 160 SEQ ID NO. 4078 |
| (N20)NGG | 8 | 48842422 | - | AAAAATTCTGCTTGTTTCTCAGG | | 1 | 5 | 118 SEQ ID NO. 4079 |
| (N20)NGG | 8 | 48842449 | - | TATGAAAATGAGTACACCATGG | | 1 | 5 | 50 SEQ ID NO. 4080 |
| (N20)NGG | 8 | 48842500 | - | TTGTAGAAACCACTGATGAGGGG | | 1 | 7 | 49 SEQ ID NO. 4081 |
| (N20)NGG | 8 | 48842501 | - | TTTGTAGAAACCACTGATGAGGG | | 1 | 4 | 90 SEQ ID NO. 4082 |
| (N20)NGG | 8 | 48842502 | - | ATTTGTAGAAACCACTGATGAGG | | 1 | 5 | 61 SEQ ID NO. 4083 |
| (N20)NGG | 8 | 48842549 | - | CTCGAAATATTTATTTTCTTTGG | | 1 | 21 | 221 SEQ ID NO. 4084 |
| (N20)NGG | 8 | 48843235 | + | CTACAATTACTCTCTTTAAGAATGG | | 1 | 3 | 78 SEQ ID NO. 4085 |
| (N20)NGG | 8 | 48843243 | + | ACTCTTTAAGAATGGAGATGAGG | | 1 | 7 | 67 SEQ ID NO. 4086 |
| (N20)NGG | 8 | 48843250 | + | AAGAATGGAGATGAGGCGCCTGG | | 1 | 4 | 41 SEQ ID NO. 4087 |
| (N20)NGG | 8 | 48843257 | + | GAGATGAGGCGCCTGGTGTTTGG | | 1 | 3 | 31 SEQ ID NO. 4088 |
| (N20)NGG | 8 | 48843282 | + | GATCCCAACTTCAGATCCAGCGG | | 2 | 2 | 31 SEQ ID NO. 4089 |
| (N20)NGG | 8 | 48843318 | + | AGCTAAACCTAAAGATTTTTCGG | | 1 | 9 | 84 SEQ ID NO. 4090 |
| (N20)NGG | 8 | 48843333 | + | TTTTTCGGCTTTCATTAACCTGG | | 1 | 2 | 33 SEQ ID NO. 4091 |
| (N20)NGG | 8 | 48843336 | + | TTCGGCTTTCATTAACCTGGTCG | | 1 | 2 | 18 SEQ ID NO. 4092 |
| (N20)NGG | 8 | 48843347 | + | TTAACCTGGTGGAATTTTGCAGG | | 1 | 4 | 41 SEQ ID NO. 4093 |
| (N20)NGG | 8 | 48843354 | + | GGTGGAATTTTGCAGGTATTTGG | | 1 | 4 | 39 SEQ ID NO. 4094 |
| (N20)NGG | 8 | 48843246 | - | GTTGGGATCATCCAAACACCAGG | | 1 | 2 | 24 SEQ ID NO. 4095 |
| (N20)NGG | 8 | 48843263 | - | TAGCCGCTGATCTGAAGTTGGG | | 1 | 1 | 10 SEQ ID NO. 4096 |
| (N20)NGG | 8 | 48843264 | - | TTAGCCGCTGATCTGAAGTTGG | | 1 | 1 | 14 SEQ ID NO. 4097 |
| (N20)NGG | 8 | 48843276 | - | GCTGATGCAAGTTAGCCGCTGG | | 1 | 1 | 5 SEQ ID NO. 4098 |
| (N20)NGG | 8 | 48843294 | - | GAAAATCTTTTAGGTTTAGCTGG | | 1 | 1 | 57 SEQ ID NO. 4099 |
| (N20)NGG | 8 | 48843303 | - | ATGAAAGCCGAAAAATCTTTAGG | | 1 | 2 | 39 SEQ ID NO. 4100 |

FIG. 12 cont.

| site_type | site_chromosome | site_start_nucleotide | site_strand | target_site_sequence_with NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48843329 | - | AATACCTGCAAAATTCCACCAGG | | 1 | 3 | 53 SEQ ID NO. 4101 |
| (N20)NGG | 8 | 48845579 | + | TATTGTTTTCTTTATTTAAAGG | | 1 | 63 | 1249 SEQ ID NO. 4102 |
| (N20)NGG | 8 | 48845693 | + | TTTGAAGATTGTTGAGAAATTGG | | 1 | 6 | 137 SEQ ID NO. 4103 |
| (N20)NGG | 8 | 48845721 | + | ACACTTGAAATACAGACTGTTGG | | 1 | 3 | 40 SEQ ID NO. 4104 |
| (N20)NGG | 8 | 48845722 | + | CACTTGAAATACAGACTGTTGGG | | 1 | 2 | 54 SEQ ID NO. 4105 |
| (N20)NGG | 8 | 48845723 | + | ACTTGAAATACAGACTGTTGGGG | | 1 | 4 | 53 SEQ ID NO. 4106 |
| (N20)NGG | 8 | 48845732 | + | ACAGACTGTTGGGAACAAGAGG | | 1 | 4 | 66 SEQ ID NO. 4107 |
| (N20)NGG | 8 | 48845619 | - | ATGATTCAGACTTTCACTGGAGG | | 1 | 1 | 44 SEQ ID NO. 4108 |
| (N20)NGG | 8 | 48845622 | - | TAAATGATTCAGACTTTCACTGG | | 1 | 5 | 68 SEQ ID NO. 4109 |
| (N20)NGG | 8 | 48845667 | - | TTTCTCAACAATCTTCAAAACGG | | 1 | 7 | 153 SEQ ID NO. 4110 |
| (N20)NGG | 8 | 48846524 | + | GTCATGCTGTCTTTCTGGCCAGG | | 1 | 1 | 29 SEQ ID NO. 4111 |
| (N20)NGG | 8 | 48846525 | + | TCATGCTGTCTTTCTGGCCAGGG | | 1 | 7 | 81 SEQ ID NO. 4112 |
| (N20)NGG | 8 | 48846561 | + | TCTGAAGACCACCGTGCTTCAGG | | 1 | 2 | 22 SEQ ID NO. 4113 |
| (N20)NGG | 8 | 48846562 | + | CTGAAGACCACCGTGCTTCAGGG | | 1 | 2 | 16 SEQ ID NO. 4114 |
| (N20)NGG | 8 | 48846563 | + | TGAAGACCACCGTGCTTCAGGGG | | 1 | 1 | 18 SEQ ID NO. 4115 |
| (N20)NGG | 8 | 48846576 | + | GCTTCAGGGGAAGTCAGAACTGG | | 1 | 5 | 37 SEQ ID NO. 4116 |
| (N20)NGG | 8 | 48846583 | + | GGGAAGTCAGAACTGGCAAATGG | | 1 | 7 | 71 SEQ ID NO. 4117 |
| (N20)NGG | 8 | 48846587 | + | AGTCAGAACTGGCAAATGGAAGG | | 1 | 6 | 60 SEQ ID NO. 4118 |
| (N20)NGG | 8 | 48846611 | + | GCCCACATACAAAGACTACGTGG | | 1 | 1 | 11 SEQ ID NO. 4119 |
| (N20)NGG | 8 | 48846650 | + | CCTGAGCTCTGACCAGATGATGG | | 2 | 5 | 79 SEQ ID NO. 4120 |
| (N20)NGG | 8 | 48846520 | - | CAGATTCAGACTCAGGGCCCTGG | | 1 | 11 | 80 SEQ ID NO. 4121 |
| (N20)NGG | 8 | 48846526 | - | GGTCTTCAGATTCAGACTCAGG | | 1 | 6 | 78 SEQ ID NO. 4122 |
| (N20)NGG | 8 | 48846527 | - | TGGTCTTCAGATTCAGACTCAGG | | 1 | 4 | 50 SEQ ID NO. 4123 |
| (N20)NGG | 8 | 48846547 | - | TGACTTCCCCTGAAGCACGTGG | | 1 | 1 | 20 SEQ ID NO. 4124 |
| (N20)NGG | 8 | 48846550 | - | TTCTGACTTCCCCTGAAGCACGG | | 1 | 6 | 77 SEQ ID NO. 4125 |
| (N20)NGG | 8 | 48846590 | - | TCCACGTAGTCTTTGTATGTGG | | 1 | 2 | 18 SEQ ID NO. 4126 |
| (N20)NGG | 8 | 48846591 | - | ATCCACGTAGTCTTTGTATGTGTG | | 1 | 2 | 11 SEQ ID NO. 4127 |
| (N20)NGG | 8 | 48846628 | - | CCATCACTGGTCAGAGCTCAGG | | 1 | 3 | 26 SEQ ID NO. 4128 |
| (N20)NGG | 8 | 48846640 | - | TGGTAAATGTTACCATCACTCGG | | 2 | 3 | 48 SEQ ID NO. 4129 |
| (N20)NGG | 8 | 48847576 | + | TTTTCTTTTTTCAGTGCATCAGG | | 1 | 14 | 294 SEQ ID NO. 4130 |
| (N20)NGG | 8 | 48847577 | + | TTTCTTTTTTCAGTGCATCAGGG | | 2 | 19 | 285 SEQ ID NO. 4131 |
| (N20)NGG | 8 | 48847606 | + | CAGAATATGTTCTAAACCAGTGG | | 2 | 4 | 56 SEQ ID NO. 4132 |
| (N20)NGG | 8 | 48847618 | + | TAAACCAGTGGTCCTTCCAAAGG | | 1 | 2 | 27 SEQ ID NO. 4133 |

FIG. 12 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 8 | 48847600 | - | TTTACCTTTGGAAGGACCACTGG | | 1 | 4 | 57 | SEQ ID NO. 4134 |
| (N20)NGG | 8 | 48847608 | - | ATTCAGAATTTACCTTTGAAGG | | 1 | 6 | 102 | SEQ ID NO. 4135 |
| (N20)NGG | 8 | 48847612 | - | TTAAATTCAGAATTTACCTTTGG | | 1 | 13 | 150 | SEQ ID NO. 4136 |
| (N20)NGG | 8 | 48848291 | + | GTTTGCTGATTATTTCCGGTAGG | | 1 | 2 | 15 | SEQ ID NO. 4137 |
| (N20)NGG | 8 | 48848300 | + | TTATTTCCGTAGGTTCCTGAGG | | 1 | 1 | 21 | SEQ ID NO. 4138 |
| (N20)NGG | 8 | 48848318 | + | TGAGGTGTATACTCCAGTTCTGG | | 1 | 1 | 22 | SEQ ID NO. 4139 |
| (N20)NGG | 8 | 48848330 | + | TCCAGTTCTGGAGCACCTCGTGG | | 1 | 1 | 20 | SEQ ID NO. 4140 |
| (N20)NGG | 8 | 48848378 | + | GTACAGTCCAAAAATGCAGCTGG | | 1 | 1 | 30 | SEQ ID NO. 4141 |
| (N20)NGG | 8 | 48848402 | + | GTGTTGCAGAGCCATAGTGAAGG | | 1 | 2 | 27 | SEQ ID NO. 4142 |
| (N20)NGG | 8 | 48848417 | + | AGTGAAGGTGTTCCTAGCTTTGG | | 1 | 2 | 24 | SEQ ID NO. 4143 |
| (N20)NGG | 8 | 48848427 | + | TTCCTAGCTTTGGCAGCAAAAGG | | 1 | 5 | 56 | SEQ ID NO. 4144 |
| (N20)NGG | 8 | 48848428 | + | TCCTAGCTTTGGCAGCAAAAGGG | | 1 | 7 | 62 | SEQ ID NO. 4145 |
| (N20)NGG | 8 | 48848440 | + | CAGCAAAAGGGCCAGTTCTCAGG | | 1 | 3 | 45 | SEQ ID NO. 4146 |
| (N20)NGG | 8 | 48848459 | + | CAGGAATTGCATTAGTACTGTGG | | 1 | 2 | 53 | SEQ ID NO. 4147 |
| (N20)NGG | 8 | 48848460 | + | AGGAATTGCATTAGTACTGTGGG | | 1 | 2 | 49 | SEQ ID NO. 4148 |
| (N20)NGG | 8 | 48848284 | - | TATACACCTCAGGAACCTACCG | | 1 | 2 | 14 | SEQ ID NO. 4149 |
| (N20)NGG | 8 | 48848294 | - | AGAACTGGAGTATACACCTCAGG | | 1 | 2 | 22 | SEQ ID NO. 4150 |
| (N20)NGG | 8 | 48848309 | - | ACCACGAGGTGCTCCAGAACTGG | | 1 | 4 | 9 | SEQ ID NO. 4151 |
| (N20)NGG | 8 | 48848323 | - | TGTCTATCTGCATCACCACGAGG | | 1 | 2 | 13 | SEQ ID NO. 4152 |
| (N20)NGG | 8 | 48848350 | - | GCATTTTTGGACTGTACTGTGG | | 1 | 2 | 23 | SEQ ID NO. 4153 |
| (N20)NGG | 8 | 48848351 | - | TGCATTTTTGGACTGTACTGTGG | | 1 | 4 | 39 | SEQ ID NO. 4154 |
| (N20)NGG | 8 | 48848363 | - | CAACACACCAGTGCATTTTTGG | | 2 | 5 | 47 | SEQ ID NO. 4155 |
| (N20)NGG | 8 | 48848391 | - | AGCTAGGAACACCTTCACTATGG | | 1 | 1 | 19 | SEQ ID NO. 4156 |
| (N20)NGG | 8 | 48848407 | - | GCCCTTTTGCTGCCAAAGCTAGG | | 2 | 4 | 48 | SEQ ID NO. 4157 |
| (N20)NGG | 8 | 48848429 | - | CTAATGCAATTCCTGAGAACTGG | | 2 | 5 | 31 | SEQ ID NO. 4158 |
| (N20)NGG | 8 | 48848921 | + | ACCTTTTCTAAAGCCGTGCAAGG | | 1 | 2 | 19 | SEQ ID NO. 4159 |
| (N20)NGG | 8 | 48849006 | + | TTCCTCACCCAGACAGACACTGG | | 1 | 2 | 48 | SEQ ID NO. 4160 |
| (N20)NGG | 8 | 48848900 | - | ACCTTGCGGCTTTAGAAAAGG | | 1 | 3 | 13 | SEQ ID NO. 4161 |
| (N20)NGG | 8 | 48848912 | - | TTTGCGTTTATAACCTTGCACGG | | 1 | 1 | 29 | SEQ ID NO. 4162 |
| (N20)NGG | 8 | 48848986 | - | CACCAGTGTCTCTGGGTGAGG | | 1 | 6 | 146 | SEQ ID NO. 4163 |
| (N20)NGG | 8 | 48848991 | - | GTCGTCACCAGTGTCTCTGTCTGG | | 1 | 2 | 9 | SEQ ID NO. 4164 |
| (N20)NGG | 8 | 48848992 | - | GGTCGTCACCAGTGTCTCTGTCTGG | | 1 | 1 | 13 | SEQ ID NO. 4165 |
| (N20)NGG | 8 | 48849013 | - | AGCTTGGCATCTGATAAACACGG | | 1 | 6 | 38 | SEQ ID NO. 4166 |

FIG. 12 cont.

| site_type | site_chr omosome | site_start_ nucleotide | site_s trand | target_site_sequence_wi th_NGG | genome_wide_ hits_with_1 or_less_mism atches | genome_wide_ hits_with_ 2_or_less_m ismatches | genome_wide_ hits_with_ 3_or_less_mism atches | |
|---|---|---|---|---|---|---|---|---|
| (N20)NGG | 8 | 48849029 | - | GCAACAGACTGGAGGAAGCTTGG | 1 | 1 | 3 | 62 SEQ ID NO. 4167 |
| (N20)NGG | 8 | 48849037 | - | AGACGCTTGCAACAGACTGGAGG | | 1 | 3 | 15 SEQ ID NO. 4168 |
| (N20)NGG | 8 | 48849040 | - | GCAAGACGCTTGCAACAGACTGG | | 1 | 1 | 11 SEQ ID NO. 4169 |
| (N20)NGG | 8 | 48849067 | - | TTAGTTCACTTACTGTGTCAAGG | | 1 | 5 | 63 SEQ ID NO. 4170 |
| (N20)NGG | 8 | 48852110 | + | AATAAATATTATGTATTTGCAGG | | 3 | 18 | 262 SEQ ID NO. 4171 |
| (N20)NGG | 8 | 48852122 | + | GTATTTGCAGGTTTCTAATATGG | | 1 | 6 | 100 SEQ ID NO. 4172 |
| (N20)NGG | 8 | 48852125 | + | TTTGCAGGTTTCTAATATGGTGG | | 1 | 4 | 49 SEQ ID NO. 4173 |
| (N20)NGG | 8 | 48852170 | + | AAATAAACTGCAGTACTTTATGG | | 1 | 6 | 143 SEQ ID NO. 4174 |
| (N20)NGG | 8 | 48852183 | + | TACTTTATGGAGCAGTTTTATGG | | 1 | 6 | 154 SEQ ID NO. 4175 |
| (N20)NGG | 8 | 48852200 | + | TTATGGAATCATCAGAAATGTGG | | 1 | 2 | 66 SEQ ID NO. 4176 |
| (N20)NGG | 8 | 48852215 | + | AAATGTGGATTCGAACAACAAGG | | 1 | 3 | 35 SEQ ID NO. 4177 |
| (N20)NGG | 8 | 48852237 | + | GAGTTATCTATTGCTATCCGTGG | | 1 | 1 | 5 SEQ ID NO. 4178 |
| (N20)NGG | 8 | 48852243 | + | TCTATTGCTATCCGTGGATATGG | | 1 | 2 | 10 SEQ ID NO. 4179 |
| (N20)NGG | 8 | 48852255 | - | CGTGGATATGGACTTTTTGCAGG | | 1 | 2 | 6 SEQ ID NO. 4180 |
| (N20)NGG | 8 | 48852771 | + | CTGCAAAAAGTCCATATCCACGG | | 1 | 2 | 43 SEQ ID NO. 4181 |
| (N20)NGG | 8 | 48855771 | + | ATGGCATTTGCATTTGCAGCTGG | | 1 | 4 | 65 SEQ ID NO. 4182 |
| (N20)NGG | 8 | 48855821 | + | TCAGTTTAGCACCTGCCTTCTGG | | 1 | 5 | 37 SEQ ID NO. 4183 |
| (N20)NGG | 8 | 48855859 | + | TATTTGAAGTCTTGTTAAAGTGG | | 1 | 9 | 113 SEQ ID NO. 4184 |
| (N20)NGG | 8 | 48855908 | + | AAAAGCTGCACTTTCAGCCCTGG | | 1 | 3 | 58 SEQ ID NO. 4185 |
| (N20)NGG | 8 | 48855926 | + | CCTGGAATCCTTTCTGAAACAGG | | 2 | 13 | 97 SEQ ID NO. 4186 |
| (N20)NGG | 8 | 48855778 | - | GAGATGCATGCAGGGCAAATAGG | | 1 | 3 | 33 SEQ ID NO. 4187 |
| (N20)NGG | 8 | 48855786 | - | GCTAAACTGAGATGCATGCAGG | | 1 | 1 | 16 SEQ ID NO. 4188 |
| (N20)NGG | 8 | 48855787 | - | TGCTAAACTGAGATGCATGCAGG | | 1 | 1 | 21 SEQ ID NO. 4189 |
| (N20)NGG | 8 | 48855810 | - | CACGTAGTTGTCCAGAAGGCAGG | | 1 | 1 | 11 SEQ ID NO. 4190 |
| (N20)NGG | 8 | 48855814 | - | GAGACACGTAGTTGTCCAGAAGG | | 1 | 2 | 10 SEQ ID NO. 4191 |
| (N20)NGG | 8 | 48855864 | - | TTTCAATTCTACATTTGTCTGGG | | 2 | 8 | 158 SEQ ID NO. 4192 |
| (N20)NGG | 8 | 48855865 | - | TTTTCAATTCTACATTTGTGTGG | | 1 | 10 | 148 SEQ ID NO. 4193 |
| (N20)NGG | 8 | 48855903 | - | CTGTTTCAGAAAGGATTCCAGGG | | 1 | 7 | 72 SEQ ID NO. 4194 |
| (N20)NGG | 8 | 48855904 | - | CCTGTTTCAGAAAGGATTCCAGG | | 1 | 5 | 60 SEQ ID NO. 4195 |
| (N20)NGG | 8 | 48855912 | - | TTGTGGTACCTGTTTCAGAAAGG | | 1 | 1 | 35 SEQ ID NO. 4196 |
| (N20)NGG | 8 | 48856443 | + | AAGAGATATGCTGTGCCCTCAGG | | 1 | 3 | 35 SEQ ID NO. 4197 |
| (N20)NGG | 8 | 48856447 | + | GATATGCTGTGCCCTCAGTAGG | | 1 | 2 | 21 SEQ ID NO. 4198 |
| (N20)NGG | 8 | 48856465 | + | GTAGGATTCTGTTTATAATGAGG | | 2 | 6 | 58 SEQ ID NO. 4199 |

FIG. 12 cont.

| site_type | site_chr omosome | site_start_ nucleotide | site_s trand | target_site_sequence_wi th_NGG | genome_wide_ hits_with_1 or_less_mism atches | genome_wide_ hits_with_ 2_or_less_m ismatches | genome_wide_ hits_with_3_ or_less_mism atches | | |
|---|---|---|---|---|---|---|---|---|---|
| (N20)NGG | 8 | 48856436 | - | ATAAACAGAATCCTACCTGAGGG | 1 | | 3 | 56 | SEQ ID NO. 4200 |
| (N20)NGG | 8 | 48856437 | - | TATGAACAGAATCCTACCTGAGG | 1 | | 3 | 45 | SEQ ID NO. 4201 |
| (N20)NGG | 8 | 48856549 | + | CCCTAGATCCCAGACTTCAAGG | 1 | | 5 | 61 | SEQ ID NO. 4202 |
| (N20)NGG | 8 | 48856550 | + | CCTAGATCCCCAGACTTCAAGGG | 1 | | 1 | 27 | SEQ ID NO. 4203 |
| (N20)NGG | 8 | 48856574 | + | GATTTTTAATTTTGTACTAAAGG | 1 | | 12 | 240 | SEQ ID NO. 4204 |
| (N20)NGG | 8 | 48856589 | + | ACTAAAGGCAATTCGTCCTCAGG | 1 | | 2 | 10 | SEQ ID NO. 4205 |
| (N20)NGG | 8 | 48856593 | + | AAGGCAATTCGTCCTCAGGTAGG | 1 | | 3 | 11 | SEQ ID NO. 4206 |
| (N20)NGG | 8 | 48856527 | - | CCTTGAAGTCTGGGGATCTAGGG | 1 | | 1 | 35 | SEQ ID NO. 4207 |
| (N20)NGG | 8 | 48856528 | - | CCCTTGAAGTCTGGGGATCTAGG | 1 | | 2 | 43 | SEQ ID NO. 4208 |
| (N20)NGG | 8 | 48856535 | - | AAAATCTCCCTTGAAGTCTGGGG | 1 | | 4 | 74 | SEQ ID NO. 4209 |
| (N20)NGG | 8 | 48856536 | - | AAAAATCTCCCTTGAAGTCTGGG | 1 | | 2 | 76 | SEQ ID NO. 4210 |
| (N20)NGG | 8 | 48856537 | - | TAAAAATCTCCCTTGAAGTCTGG | 1 | | 3 | 64 | SEQ ID NO. 4211 |
| (N20)NGG | 8 | 48856583 | - | AGTAATATTAATCCTACCTGAGG | 1 | | 2 | 42 | SEQ ID NO. 4212 |
| (N20)NGG | 8 | 48866218 | + | AGAGCCCAAACTACCTGTTCTGG | 1 | | 3 | 21 | SEQ ID NO. 4213 |
| (N20)NGG | 8 | 48866222 | + | CCCAAACTACCTGTTCTGCCAGG | 1 | | 3 | 26 | SEQ ID NO. 4214 |
| (N20)NGG | 8 | 48866233 | + | TGTTCTGCCAGGATGTCTGAAGG | 2 | | 2 | 31 | SEQ ID NO. 4215 |
| (N20)NGG | 8 | 48866234 | + | GTTCTGGCAGGATGTCTGAAGGG | 1 | | 5 | 78 | SEQ ID NO. 4216 |
| (N20)NGG | 8 | 48866235 | + | TTCTGGCAGGATGTCTGAAGGGG | 1 | | 3 | 60 | SEQ ID NO. 4217 |
| (N20)NGG | 8 | 48866272 | + | GTGCAACTTCACTAAGTCCATGG | 1 | | 3 | 17 | SEQ ID NO. 4218 |
| (N20)NGG | 8 | 48866279 | + | TTCACTAAGTCCATGGAAGAAGG | 2 | | 15 | 82 | SEQ ID NO. 4219 |
| (N20)NGG | 8 | 48866289 | + | CCATGGAAGAAGGTATTGCTTGG | 1 | | 3 | 32 | SEQ ID NO. 4220 |
| (N20)NGG | 8 | 48866200 | - | CCTGCCAGAACAGGTAGTTTGG | 2 | | 3 | 20 | SEQ ID NO. 4221 |
| (N20)NGG | 8 | 48866201 | - | TCCTGCCAGAACAGGTAGTTTGG | 3 | | 4 | 21 | SEQ ID NO. 4222 |
| (N20)NGG | 8 | 48866209 | - | TTCAGACATCCTGCCAGAACAGG | 1 | | 3 | 37 | SEQ ID NO. 4223 |
| (N20)NGG | 8 | 48866240 | - | AGTGAAGTTGCACAGAAGTCAGG | 2 | | 6 | 91 | SEQ ID NO. 4224 |
| (N20)NGG | 8 | 48866267 | - | CCAAGCAATACCTTCTTCCATGG | 2 | | 6 | 41 | SEQ ID NO. 4225 |
| (N20)NGG | 8 | 48866393 | + | GAAAAAGTATATGAGCTCCTAGG | 1 | | 1 | 63 | SEQ ID NO. 4226 |
| (N20)NGG | 8 | 48866401 | + | ATATGAGCTCCTAGGATTATTGG | 1 | | 5 | 34 | SEQ ID NO. 4227 |
| (N20)NGG | 8 | 48866402 | + | TATGAGCTCCTAGGATTATTGG | 2 | | 4 | 33 | SEQ ID NO. 4228 |
| (N20)NGG | 8 | 48866461 | + | AAACCTGTTCCGCGCTTTTCTGG | 1 | | 1 | 10 | SEQ ID NO. 4229 |
| (N20)NGG | 8 | 48866462 | + | AACCTGTTCCGCGCTTTTCTGGG | 1 | | 2 | 11 | SEQ ID NO. 4230 |
| (N20)NGG | 8 | 48866479 | + | TCTGGGTGAACTTAAGACCCAGG | 1 | | 2 | 19 | SEQ ID NO. 4231 |
| (N20)NGG | 8 | 48866388 | - | GAACTTCACCCAATAATCCTAGG | 1 | | 1 | 21 | SEQ ID NO. 4232 |

FIG. 12 cont.

| site_type | site_chr cmosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48866413 | - | GCATTATTTATCATCTCACTAGG |   | 1 | 6 | 60 SEQ ID NO. 4233 |
| (N20)NGG | 8 | 48866442 | - | CACCCAGAAAAGCGCGGAACAGG |   | 1 | 1 | 8 SEQ ID NO. 4234 |
| (N20)NGG | 8 | 48866448 | - | TAAGTTCACCCAGAAAAGCGCGG |   | 1 | 2 | 21 SEQ ID NO. 4235 |
| (N20)NGG | 8 | 48866474 | - | TCATAAAGTTCATCATACCTGGG |   | 1 | 4 | 38 SEQ ID NO. 4236 |
| (N20)NGG | 8 | 48866475 | - | GTCATAAAGTTCATCATACCTGG |   | 1 | 2 | 23 SEQ ID NO. 4237 |
| (N20)NGG | 8 | 48866930 | + | TTTTAGAAGTTCTAGACTCATGG |   | 1 | 5 | 86 SEQ ID NO. 4238 |
| (N20)NGG | 8 | 48866946 | + | CTCATGGATGAATTTAAAATTGG |   | 1 | 9 | 111 SEQ ID NO. 4239 |
| (N20)NGG | 8 | 48866970 | + | GAATTATTTAGTAAATTCTATGG |   | 2 | 6 | 170 SEQ ID NO. 4240 |
| (N20)NGG | 8 | 48867006 | + | AAAAAAAATACCAGATACAGG |   | 9 | 181 | 2285 SEQ ID NO. 4241 |
| (N20)NGG | 8 | 48866996 | - | AAATGCATCTCACCTGTATCTGG |   | 1 | 3 | 35 SEQ ID NO. 4242 |
| (N20)NGG | 8 | 48868493 | + | TAAATGTAAAATTCCAGCCCTGG |   | 3 | 11 | 94 SEQ ID NO. 4243 |
| (N20)NGG | 8 | 48868508 | + | AGCCCTGGACTTTCTTATTAAGG |   | 3 | 7 | 43 SEQ ID NO. 4244 |
| (N20)NGG | 8 | 48868428 | - | AACACTGGTACAAGTGTTCTAGG |   | 1 | 7 | 53 SEQ ID NO. 4245 |
| (N20)NGG | 8 | 48868443 | - | TCTATCTTTTGTATAAACACTGG |   | 4 | 6 | 81 SEQ ID NO. 4246 |
| (N20)NGG | 8 | 48868484 | - | TTAATAAGAAGTCCAGGGCTGG |   | 2 | 6 | 50 SEQ ID NO. 4247 |
| (N20)NGG | 8 | 48868488 | - | TACCTTAATAAGAAGGTCCAGGG |   | 1 | 3 | 33 SEQ ID NO. 4248 |
| (N20)NGG | 8 | 48868489 | - | TTACCTTAATAAGAAGGTCCAGG |   | 1 | 1 | 29 SEQ ID NO. 4249 |
| (N20)NGG | 8 | 48868495 | - | ACATAATTACCTTAATAAGAAGG |   | 1 | 4 | 86 SEQ ID NO. 4250 |
| (N20)NGG | 8 | 48869787 | + | ATGTATTTTCTTTAGAAAAAATGG |   | 5 | 45 | 588 SEQ ID NO. 4251 |
| (N20)NGG | 8 | 48869788 | + | TGTATTTTCTTTAGAAAAAATGGG |   | 2 | 29 | 518 SEQ ID NO. 4252 |
| (N20)NGG | 8 | 48869823 | + | ACCTTACTCTGTTGAAATTAAGG |   | 1 | 2 | 36 SEQ ID NO. 4253 |
| (N20)NGG | 8 | 48869753 | - | AGAAAATACATAAAACTTTAGG |   | 2 | 29 | 537 SEQ ID NO. 4254 |
| (N20)NGG | 8 | 48869789 | - | CAGAGTAAGGTGCGATCTTCTGG |   | 1 | 1 | 8 SEQ ID NO. 4255 |
| (N20)NGG | 8 | 48869802 | - | ACCTTAATTTCAACAGAGTAAGG |   | 1 | 1 | 47 SEQ ID NO. 4256 |
| (N20)NGG | 8 | 48869950 | + | TTAGTTTTTTCCAGAGATTTCCG |   | 2 | 12 | 158 SEQ ID NO. 4257 |
| (N20)NGG | 8 | 48869969 | + | TCGGTTTTGCTTGTTATTTGTCCGG |   | 2 | 5 | 89 SEQ ID NO. 4258 |
| (N20)NGG | 8 | 48870008 | + | TTTGAAGTAAGTTGACAATTTTGG |   | 1 | 5 | 73 SEQ ID NO. 4259 |
| (N20)NGG | 8 | 48869938 | - | TACAAGCAAACCGAAATCTCTGG |   | 1 | 4 | 14 SEQ ID NO. 4260 |
| (N20)NGG | 8 | 48869966 | - | CAATACTGTTGAGTGACTTCCGG |   | 3 | 3 | 30 SEQ ID NO. 4261 |
| (N20)NGG | 8 | 48872530 | + | CGCGCGGGAGCGGACTCGGCGG |   | 1 | 2 | 20 SEQ ID NO. 4262 |
| (N20)NGG | 8 | 48872535 | + | GGGAGCGGGACTCGGCGGCATGG |   | 1 | 2 | 34 SEQ ID NO. 4263 |
| (N20)NGG | 8 | 48872538 | + | AGCGGGACTCGGCGGCATGGCGG |   | 1 | 2 | 8 SEQ ID NO. 4264 |
| (N20)NGG | 8 | 48872539 | + | GCGGGACTCGGCGGCATGGCGGG |   | 1 | 1 | 11 SEQ ID NO. 4265 |

FIG. 12 cont.

| site type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 8 | 48872545 | + | CTCGGCGGCATGGCGGGCTCCGG | | 1 | 2 | 11 SEQ ID NO. 4266 |
| (N20)NGG | 8 | 48872551 | + | GGCATGGCGGGCTCCGGAGCCGG | | 1 | 2 | 26 SEQ ID NO. 4267 |
| (N20)NGG | 8 | 48872573 | + | GTGTGCGTTGCTCCCTGCTGCGG | | 1 | 4 | 47 SEQ ID NO. 4268 |
| (N20)NGG | 8 | 48872580 | + | TTGCTCCCTGCTGCGGCTGCAGG | | 1 | 4 | 73 SEQ ID NO. 4269 |
| (N20)NGG | 8 | 48872598 | + | GCAGGAGACCTTGTCCGCTGCGG | | 1 | 2 | 14 SEQ ID NO. 4270 |
| (N20)NGG | 8 | 48872608 | + | TTGTCCGCTGCGGACCGCTGCGG | | 1 | 1 | 5 SEQ ID NO. 4271 |
| (N20)NGG | 8 | 48872619 | + | GGACCGCTGCGGTGCTGCCCTGG | | 1 | 1 | 23 SEQ ID NO. 4272 |
| (N20)NGG | 8 | 48872623 | + | CGCTGCGGTGCTGCCCTGGCCGG | | 1 | 4 | 30 SEQ ID NO. 4273 |
| (N20)NGG | 8 | 48872641 | + | GCCGGTCATCAACTGATCCGCGG | | 1 | 1 | 1 SEQ ID NO. 4274 |
| (N20)NGG | 8 | 48872646 | + | TCATCAACTGATCCGCGGCCTGG | | 1 | 1 | 5 SEQ ID NO. 4275 |
| (N20)NGG | 8 | 48872647 | + | CATCAACTGATCCGCGGCCTGGG | | 1 | 1 | 64 SEQ ID NO. 4276 |
| (N20)NGG | 8 | 48872648 | + | ATCAACTGATCCGCGGCCTGGGG | | 1 | 1 | 3 SEQ ID NO. 4277 |
| (N20)NGG | 8 | 48872652 | + | ACTGATCCGCGGCCTGGGGCAGG | | 1 | 1 | 23 SEQ ID NO. 4278 |
| (N20)NGG | 8 | 48872679 | + | CGTCCTGAGCAGCCCCGCGCGG | | 1 | 3 | 29 SEQ ID NO. 4279 |
| (N20)NGG | 8 | 48872685 | + | GAGCAGCCCCGCGGTGCTGG | | 2 | 5 | 34 SEQ ID NO. 4280 |
| (N20)NGG | 8 | 48872686 | + | AGCAGCCCCGCGGTGCTGCTGGG | | 1 | 4 | 35 SEQ ID NO. 4281 |
| (N20)NGG | 8 | 48872689 | + | AGCAGCCCCGCGGTGCTGGGTGG | | 1 | 4 | 57 SEQ ID NO. 4282 |
| (N20)NGG | 8 | 48872690 | + | GCAGCCCCGCGGTGCTGGGTGGG | | 1 | 2 | 36 SEQ ID NO. 4283 |
| (N20)NGG | 8 | 48872696 | + | CCGCGGTGCTGGGTGGGTACCGG | | 2 | 7 | 22 SEQ ID NO. 4284 |
| (N20)NGG | 8 | 48872706 | + | GGGTGGGTACCGGCCCGAGCTGG | | 1 | 3 | 18 SEQ ID NO. 4285 |
| (N20)NGG | 8 | 48872707 | + | GGTGGGTACCGGCCCGAGCTGGG | | 1 | 2 | 6 SEQ ID NO. 4286 |
| (N20)NGG | 8 | 48872542 | – | GGAGCAACGCACACCGGCTCCGG | | 1 | 2 | 15 SEQ ID NO. 4287 |
| (N20)NGG | 8 | 48872548 | – | CAGCAGGGAGCAACGCACACCGG | | 2 | 9 | 105 SEQ ID NO. 4288 |
| (N20)NGG | 8 | 48872563 | – | GGTCTCCTGCAGCCGCAGCAGGG | | 1 | 4 | 51 SEQ ID NO. 4289 |
| (N20)NGG | 8 | 48872564 | – | AGGTCTCCTGCAGCCGCAGCAGG | | 1 | 3 | 50 SEQ ID NO. 4290 |
| (N20)NGG | 8 | 48872584 | – | GCAGCGGTCCGCAGCGGACAAGG | | 1 | 1 | 5 SEQ ID NO. 4291 |
| (N20)NGG | 8 | 48872590 | – | AGCACCGCAGCGGTCCGCAGCGG | | 2 | 3 | 10 SEQ ID NO. 4292 |
| (N20)NGG | 8 | 48872600 | – | CCCAGGGCAGCACCGCAGCGG | | 1 | 3 | 40 SEQ ID NO. 4293 |
| (N20)NGG | 8 | 48872614 | – | GATCAGTTGATGACCGGCCAGGG | | 1 | 1 | 8 SEQ ID NO. 4294 |
| (N20)NGG | 8 | 48872615 | – | GGATCAGTTGATGACCGGCCAGG | | 1 | 2 | 15 SEQ ID NO. 4295 |
| (N20)NGG | 8 | 48872620 | – | GCCGCGGATCAGTTGATGACCGG | | 1 | 1 | 4 SEQ ID NO. 4296 |
| (N20)NGG | 8 | 48872636 | – | CCCATTCCTGCCCAGGCCGCGG | | 1 | 1 | 33 SEQ ID NO. 4297 |
| (N20)NGG | 8 | 48872642 | – | TCAGGACGCATTCCTGCCCCAGG | | 1 | 4 | 31 SEQ ID NO. 4298 |

FIG. 12 cont.

| site_type | site_chr omosome | site_start_ nucleotide | site_s trand | target_site_sequence_wi th_NGG | genome_wide_ hits_with_1_ or_less_mism atches | genome_wide_ hits_with_ 2_or_less_m ismatches | genome_wide_ hits_with_3_ or_less_mism atches | |
|---|---|---|---|---|---|---|---|---|
| (N20)NGG | 8 | 48872660 | - | GCACCGCGGGCTGCTGCTCAGG | | 1 | 32 | SEQ ID NO. 4299 |
| (N20)NGG | 8 | 48872672 | - | GGTACCCACCCAGCACCGCGGG | 1 | 1 | 18 | SEQ ID NO. 4300 |
| (N20)NGG | 8 | 48872673 | - | CGGTACCCACCCAGCACCGCGG | 1 | 1 | 15 | SEQ ID NO. 4301 |
| (N20)NGG | 8 | 48872674 | - | CCGGTACCCACCCAGCACCGCG | 1 | 1 | 16 | SEQ ID NO. 4302 |

FIG. 12 cont.

| site type | site_chr omosome | site_start_ nucleotide | site_s trand | target_site_sequence_with_NGG | genome_wide_ hits_with_1_ or_less_mism atches | genome_wide_ hits_with_2_ or_less_mism atches | genome_wide_ hits_with_3_ or_less_mism atches | | |
|---|---|---|---|---|---|---|---|---|---|
| (N20)NGG | 11 | 36594881 | + | AGCCTCTTTCCCACCCACCTTGG | 1 | 8 | 94 | SEQ ID NO. | 4303 |
| (N20)NGG | 11 | 36594882 | + | GCCTCTTTCCCACCCACCTTGGG | 1 | 2 | 65 | SEQ ID NO. | 4304 |
| (N20)NGG | 11 | 36594937 | + | CACATATTAAATTTCAGAATGG | 1 | 20 | 258 | SEQ ID NO. | 4305 |
| (N20)NGG | 11 | 36594955 | + | AATGGAAATTTAAGCTGTTCCGG | 1 | 7 | 80 | SEQ ID NO. | 4306 |
| (N20)NGG | 11 | 36594956 | + | ATGGAAATTTAAGCTGTTCCGGG | 1 | 13 | 156 | SEQ ID NO. | 4307 |
| (N20)NGG | 11 | 36594995 | + | GACACCTGAAGAGCTCAAAAGG | 1 | 2 | 47 | SEQ ID NO. | 4308 |
| (N20)NGG | 11 | 36595004 | + | AGAAGCTCAAAAGGAAAAGAAGG | 3 | 24 | 430 | SEQ ID NO. | 4309 |
| (N20)NGG | 11 | 36595016 | + | GGAAAAGAAGGATTCCTTTGAGG | 1 | 8 | 108 | SEQ ID NO. | 4310 |
| (N20)NGG | 11 | 36595017 | + | GAAAAGAAGGATTCCTTTGAGGG | 1 | 11 | 268 | SEQ ID NO. | 4311 |
| (N20)NGG | 11 | 36595018 | + | AAAAGAAGGATTCCTTTGAGGGG | 1 | 7 | 95 | SEQ ID NO. | 4312 |
| (N20)NGG | 11 | 36595031 | + | CTTTGAGGGGAAACCCTCTCTGG | 1 | 3 | 23 | SEQ ID NO. | 4313 |
| (N20)NGG | 11 | 36595052 | + | GGAGCAATCTCCAGCAGTCCTGG | 1 | 1 | 24 | SEQ ID NO. | 4314 |
| (N20)NGG | 11 | 36595058 | + | ATCTCCAGCAGTCCTGACAAGG | 1 | 3 | 46 | SEQ ID NO. | 4315 |
| (N20)NGG | 11 | 36595065 | + | GCAGTCCTGACAAGGCTGATGG | 1 | 2 | 44 | SEQ ID NO. | 4316 |
| (N20)NGG | 11 | 36595149 | + | CACGACAACGAGAAAGCAAGAGG | 1 | 1 | 19 | SEQ ID NO. | 4317 |
| (N20)NGG | 11 | 36595197 | + | CGACATCTCTGCCGCATCTGTGG | 1 | 1 | 9 | SEQ ID NO. | 4318 |
| (N20)NGG | 11 | 36595198 | + | GACATCTCTGCCGCATCTGTGGG | 1 | 1 | 14 | SEQ ID NO. | 4319 |
| (N20)NGG | 11 | 36595228 | + | TTAGAGCTGATGAGCACAACAGG | 1 | 2 | 26 | SEQ ID NO. | 4320 |
| (N20)NGG | 11 | 36595245 | + | AACAGAGATATCCAGTCCATGG | 1 | 2 | 83 | SEQ ID NO. | 4321 |
| (N20)NGG | 11 | 36595253 | + | ATATCCAGTCCATGGTCCTGTGG | 1 | 3 | 21 | SEQ ID NO. | 4322 |
| (N20)NGG | 11 | 36595257 | + | CCAGTCCATGGTCCTGTGGATGG | 1 | 5 | 41 | SEQ ID NO. | 4323 |
| (N20)NGG | 11 | 36595269 | + | CCTGTGGATGGTAAAACCCTAGG | 1 | 3 | 43 | SEQ ID NO. | 4324 |
| (N20)NGG | 11 | 36595286 | + | CCTAGGCCTTTTACGAAACAAGG | 1 | 1 | 24 | SEQ ID NO. | 4325 |
| (N20)NGG | 11 | 36595306 | + | AGGAAAAGAGAGCTACTTCCTGG | 1 | 2 | 55 | SEQ ID NO. | 4326 |
| (N20)NGG | 11 | 36595310 | + | AAAGAGAGCTACTTCCTGGCCGG | 1 | 2 | 48 | SEQ ID NO. | 4327 |
| (N20)NGG | 11 | 36595325 | + | CTGGCCGGACCTCATTGCCAAGG | 1 | 1 | 18 | SEQ ID NO. | 4328 |
| (N20)NGG | 11 | 36595333 | + | ACCTCATTGCCAAGGTTTTCCGG | 1 | 4 | 35 | SEQ ID NO. | 4329 |
| (N20)NGG | 11 | 36595346 | + | GGTTTTCCGGATCGATGTGAAGG | 1 | 1 | 1 | SEQ ID NO. | 4330 |
| (N20)NGG | 11 | 36595393 | + | CTGAGTTCTGCCATAACTGCTGG | 1 | 2 | 40 | SEQ ID NO. | 4331 |
| (N20)NGG | 11 | 36595408 | + | ACTGCTGGAGCATCATGCACAGG | 1 | 4 | 26 | SEQ ID NO. | 4332 |
| (N20)NGG | 11 | 36595433 | + | GTTTAGCAGTGCCCCATGTGAGG | 1 | 1 | 13 | SEQ ID NO. | 4333 |
| (N20)NGG | 11 | 36595447 | + | CATGTGAGGTTTACTTCCCGAGG | 1 | 1 | 12 | SEQ ID NO. | 4334 |
| (N20)NGG | 11 | 36595460 | + | CTTCCCGAGGAACGTGACCATGG | 1 | 3 | 24 | SEQ ID NO. | 4335 |

FIG. 13

| site_type | site_chr omosome | site_start_ nucleotide | site_s trand | target_site_sequence_with_NGG | genome_wide_ hits_with_1_ or_less_mism atches | genome_wide_ hits_with_2_ or_less_mism atches | genome_wide_ hits_with_3_ or_less_mism atches | |
|---|---|---|---|---|---|---|---|---|
| (N20)NGG | 11 | 36595465 | + | CGAGGAACGTGACCATGGAGTGG |   | 2 | 15 | SEQ ID NO. 4336 |
| (N20)NGG | 11 | 36595510 | + | ACATCTGCAACACTGCCCGTCGG | 1 | 1 | 12 | SEQ ID NO. 4337 |
| (N20)NGG | 11 | 36595511 | + | CATCTGCAACACTGCCCGTCGGG |   | 1 | 9 | SEQ ID NO. 4338 |
| (N20)NGG | 11 | 36595512 | + | ATCTGCAACACTGCCCGTCGGGG |   | 1 | 10 | SEQ ID NO. 4339 |
| (N20)NGG | 11 | 36595522 | + | CTGCCCGTCGGGACTCAAGAGG |   | 1 | 14 | SEQ ID NO. 4340 |
| (N20)NGG | 11 | 36595616 | + | TCAGCACAAGAGAAGAGCTCAGG |   | 6 | 78 | SEQ ID NO. 4341 |
| (N20)NGG | 11 | 36595621 | + | ACAAGAAGAGAGCTCAGGCAAGG | 1 | 9 | 140 | SEQ ID NO. 4342 |
| (N20)NGG | 11 | 36595634 | + | TCAGGCAAGATCAGCAGCAAGG |   | 2 | 57 | SEQ ID NO. 4343 |
| (N20)NGG | 11 | 36595697 | + | TAGTACCAAGCTCCTTGCAGTGG | 1 | 2 | 25 | SEQ ID NO. 4344 |
| (N20)NGG | 11 | 36595754 | + | CCAGATCTGTGAACACATTCTGG | 2 | 6 | 47 | SEQ ID NO. 4345 |
| (N20)NGG | 11 | 36595766 | + | ACACATTCTGGCTGACCCTGTGG |   | 4 | 40 | SEQ ID NO. 4346 |
| (N20)NGG | 11 | 36595795 | + | ACTGTAAGCATGTCTTTTGCCGG | 1 | 6 | 108 | SEQ ID NO. 4347 |
| (N20)NGG | 11 | 36595796 | + | CTGTAAGCATGTCTTTTGCCGGG | 1 | 2 | 51 | SEQ ID NO. 4348 |
| (N20)NGG | 11 | 36595826 | + | TCTCAGATGCCTCAAAGTCATGG | 1 | 4 | 63 | SEQ ID NO. 4349 |
| (N20)NGG | 11 | 36595827 | + | CTCAGATGCCTCAAAGTCATGGG | 1 | 3 | 49 | SEQ ID NO. 4350 |
| (N20)NGG | 11 | 36595874 | + | TCCAGTCTTCCCTACTGACCTGG | 1 | 2 | 33 | SEQ ID NO. 4351 |
| (N20)NGG | 11 | 36595919 | + | GAGCGTCTTGAATTCCCTGATGG | 1 | 1 | 19 | SEQ ID NO. 4352 |
| (N20)NGG | 11 | 36595949 | + | TCCAGCAAAGAGTGCAATGAGG | 1 | 4 | 46 | SEQ ID NO. 4353 |
| (N20)NGG | 11 | 36595952 | + | AGCAAAAGAGTCAATGAGGAGG | 2 | 4 | 92 | SEQ ID NO. 4354 |
| (N20)NGG | 11 | 36595961 | + | GTGCAATGAGGAGGTCAGTTTGG | 1 | 3 | 36 | SEQ ID NO. 4355 |
| (N20)NGG | 11 | 36595994 | + | TCACCACATCTCAAGTCACAAGG | 1 | 2 | 48 | SEQ ID NO. 4356 |
| (N20)NGG | 11 | 36596028 | + | ATTTTTGTGCACATTAATAAAGG | 1 | 11 | 171 | SEQ ID NO. 4357 |
| (N20)NGG | 11 | 36596029 | + | TTTTTGTGCACATTAATAAAGGG | 1 | 9 | 142 | SEQ ID NO. 4358 |
| (N20)NGG | 11 | 36596030 | + | TTTTGTGCACATTAATAAAGGGG | 1 | 4 | 85 | SEQ ID NO. 4359 |
| (N20)NGG | 11 | 36596031 | + | TTTGTGCACATTAATAAAGGGGG | 1 | 3 | 57 | SEQ ID NO. 4360 |
| (N20)NGG | 11 | 36596035 | + | TGCACATTAATAAAGGGGGCCGG | 1 | 1 | 18 | SEQ ID NO. 4361 |
| (N20)NGG | 11 | 36596065 | + | AACATCTTCTGTCGCTGACTCGG | 1 | 1 | 21 | SEQ ID NO. 4362 |
| (N20)NGG | 11 | 36596083 | + | CTCGGAGAGCTCAGAAGCACCGG | 2 | 2 | 28 | SEQ ID NO. 4363 |
| (N20)NGG | 11 | 36596089 | + | GAGCTCAGAAGCACCGGCTGAGG | 2 | 5 | 54 | SEQ ID NO. 4364 |
| (N20)NGG | 11 | 36596090 | + | AGCTCAGAAGCACCGGCTGAGGG | 1 | 4 | 23 | SEQ ID NO. 4365 |
| (N20)NGG | 11 | 36596133 | + | GCCTTTGCTGACAAAGAAGAAGG | 2 | 4 | 63 | SEQ ID NO. 4366 |
| (N20)NGG | 11 | 36596136 | + | TTTGCTGACAAAGAAGAAGGTGG | 2 | 11 | 153 | SEQ ID NO. 4367 |
| (N20)NGG | 11 | 36596174 | + | GTGCATGACCTTGTTCCTGCTGG | 1 | 2 | 26 | SEQ ID NO. 4368 |

FIG. 13 cont.

| site type | site chromosome | site start nucleotide | site strand | target site sequence with NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 36596182 | + | CCTTGTTCCTGCTGGCTCTGAGG | 1 | 19 | 168 | SEQ ID NO. 4369 |
| (N20)NGG | 11 | 36596183 | + | CTTGTTCCTGCTGGCTCTGAGGG | 1 | 8 | 75 | SEQ ID NO. 4370 |
| (N20)NGG | 11 | 36596188 | + | TCCTGCTGGCTCTGAGGGCGAGG | 1 | 6 | 64 | SEQ ID NO. 4371 |
| (N20)NGG | 11 | 36596200 | + | TGAGGGCGAGAATGAGCACAGG | 1 | 4 | 38 | SEQ ID NO. 4372 |
| (N20)NGG | 11 | 36596216 | + | GCACAGGCAAGCTGATGAGCTGG | 1 | 5 | 35 | SEQ ID NO. 4373 |
| (N20)NGG | 11 | 36596219 | + | CAGGCAAGCTGATGAGCTGGAGG | 1 | 5 | 67 | SEQ ID NO. 4374 |
| (N20)NGG | 11 | 36596231 | + | TGAGCTGGAGGCCATCATGCAGG | 1 | 8 | 235 | SEQ ID NO. 4375 |
| (N20)NGG | 11 | 36596232 | + | GAGCTGGAGGCCATCATGCAGGG | 3 | 247 | 3384 | SEQ ID NO. 4376 |
| (N20)NGG | 11 | 36596237 | + | GGAGGCCATCATGCAGGGAAAGG | 1 | 1 | 66 | SEQ ID NO. 4377 |
| (N20)NGG | 11 | 36596238 | + | GAGGCCATCATGCAGGGAAAGGG | 1 | 6 | 65 | SEQ ID NO. 4378 |
| (N20)NGG | 11 | 36596244 | + | ATCATGCAGGGAAAGGGCTCTGG | 1 | 3 | 42 | SEQ ID NO. 4379 |
| (N20)NGG | 11 | 36596267 | + | CCTGCAGCCAGCTGTTTGCTTGG | 2 | 7 | 76 | SEQ ID NO. 4380 |
| (N20)NGG | 11 | 36596320 | + | GTCAGTACCACAAGATGTACAGG | 1 | 1 | 13 | SEQ ID NO. 4381 |
| (N20)NGG | 11 | 36596340 | + | AGGACTGTGAAAGCCATCACAGG | 1 | 2 | 41 | SEQ ID NO. 4382 |
| (N20)NGG | 11 | 36596341 | + | GGACTGTGAAAGCCATCACAGGG | 1 | 2 | 33 | SEQ ID NO. 4383 |
| (N20)NGG | 11 | 36596374 | + | TTCAGCCTTTGCATGCCCTTCGG | 1 | 5 | 58 | SEQ ID NO. 4384 |
| (N20)NGG | 11 | 36596387 | + | TGCCCTTTCGGAATGCTGAGAAGG | 1 | 2 | 41 | SEQ ID NO. 4385 |
| (N20)NGG | 11 | 36596400 | + | GCTGAGAAGGTACTTCTGCCAGG | 1 | 2 | 53 | SEQ ID NO. 4386 |
| (N20)NGG | 11 | 36596419 | + | CAGGCTACCACCACTTTGAGTGG | 2 | 2 | 37 | SEQ ID NO. 4387 |
| (N20)NGG | 11 | 36596460 | + | GTGTCTTCCAGCACTGATGTTGG | 1 | 3 | 41 | SEQ ID NO. 4388 |
| (N20)NGG | 11 | 36596472 | + | ACTGATGTTGGCATTATTGATGG | 2 | 13 | 67 | SEQ ID NO. 4389 |
| (N20)NGG | 11 | 36596473 | + | CTGATGTTGGCATTATTGATGGG | 1 | 7 | 68 | SEQ ID NO. 4390 |
| (N20)NGG | 11 | 36596498 | + | GGCATTATTGATGGGCGTGTCTGG | 1 | 2 | 25 | SEQ ID NO. 4391 |
| (N20)NGG | 11 | 36596513 | + | GTCTGACTATCATCCTCTGTGG | 1 | 2 | 17 | SEQ ID NO. 4392 |
| (N20)NGG | 11 | 36596530 | + | CTCTGTGGATGATTACCCAGTGG | 1 | 3 | 31 | SEQ ID NO. 4393 |
| (N20)NGG | 11 | 36596552 | + | CAGTGGACACCATTGCAAAGAGG | 1 | 3 | 39 | SEQ ID NO. 4394 |
| (N20)NGG | 11 | 36596567 | + | GTTCCGCTATGATTCAGCTTTGG | 2 | 1 | 12 | SEQ ID NO. 4395 |
| (N20)NGG | 11 | 36596573 | + | AGCTTTGGTGTCTTTGATGG | 1 | 7 | 76 | SEQ ID NO. 4396 |
| (N20)NGG | 11 | 36596588 | + | GGTGTCTCTTTGATGGACATGG | 1 | 3 | 44 | SEQ ID NO. 4397 |
| (N20)NGG | 11 | 36596592 | + | GGACATGGAAGAAGACATCTTGG | 1 | 3 | 73 | SEQ ID NO. 4398 |
| (N20)NGG | 11 | 36596628 | + | ATGAAGAAGACATCTTGAAGG | 1 | 3 | 87 | SEQ ID NO. 4399 |
| (N20)NGG | 11 | 36596628 | + | GACCTTGATGATTACCTGAATGG | 1 | 3 | 23 | SEQ ID NO. 4400 |
| (N20)NGG | 11 | 36596642 | + | CCTGAATGGCCCCTTCACTGTGG | 1 | 3 | 46 | SEQ ID NO. 4401 |

| site type | site chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 36596645 | + | GAATGGCCCCTTCACTGTGTGG | 1 | 1 | 31 | SEQ ID NO. 4402 |
| (N20)NGG | 11 | 36596651 | + | CCCCTTCACTGTGGTGGTGAAGG | | 2 | 62 | SEQ ID NO. 4403 |
| (N20)NGG | 11 | 36596664 | + | GTGGTGAAGGAGTCTTGTGATGG | 1 | 2 | 30 | SEQ ID NO. 4404 |
| (N20)NGG | 11 | 36596669 | + | GAAGGAGTCTTGTGATGGAATGG | 2 | 5 | 69 | SEQ ID NO. 4405 |
| (N20)NGG | 11 | 36596670 | + | AAGGAGTCTTGTGATGGAATGGG | 1 | 4 | 63 | SEQ ID NO. 4406 |
| (N20)NGG | 11 | 36596691 | + | GGAGACGTGAGTGAGAAGCATGG | 1 | 2 | 58 | SEQ ID NO. 4407 |
| (N20)NGG | 11 | 36596692 | + | GAGACGTGAGTGAGAAGCATGGG | 1 | 3 | 33 | SEQ ID NO. 4408 |
| (N20)NGG | 11 | 36596697 | + | GTGAGTGAGAAGCATGGGACTGG | 1 | 5 | 111 | SEQ ID NO. 4409 |
| (N20)NGG | 11 | 36596698 | + | TGAGTGAAGCATGGGAGTGGG | 1 | 6 | 95 | SEQ ID NO. 4410 |
| (N20)NGG | 11 | 36596717 | + | TGGGCCTGTAGTTCCAGAAAAGG | 1 | 4 | 62 | SEQ ID NO. 4411 |
| (N20)NGG | 11 | 36596840 | + | CAAGCCATTGTGCCTTATGCTGG | 1 | 4 | 34 | SEQ ID NO. 4412 |
| (N20)NGG | 11 | 36596899 | + | TGAGTCCTCTCATTGCTGAGAGG | 1 | 12 | 64 | SEQ ID NO. 4413 |
| (N20)NGG | 11 | 36596900 | + | GAGTCCTCTCATTGCTGAGAGGG | 1 | 4 | 47 | SEQ ID NO. 4414 |
| (N20)NGG | 11 | 36596903 | + | TCCTCTCATTGCTGAGAGGGAGG | 1 | 5 | 58 | SEQ ID NO. 4415 |
| (N20)NGG | 11 | 36596936 | + | CAGTGAATTAATGCTTGAGCTGG | 1 | 3 | 44 | SEQ ID NO. 4416 |
| (N20)NGG | 11 | 36596937 | + | AGTGAATTAATGCTTGAGCTGGG | 1 | 2 | 71 | SEQ ID NO. 4417 |
| (N20)NGG | 11 | 36596940 | + | GAATTAATGCTTGAGCTGGGAGG | 1 | 3 | 74 | SEQ ID NO. 4418 |
| (N20)NGG | 11 | 36596950 | + | TTGAGCTGGGAGGCATTCTCCGG | 1 | 2 | 44 | SEQ ID NO. 4419 |
| (N20)NGG | 11 | 36596971 | + | GGACTTTCAAGTTCATCTTCAGG | 1 | 3 | 48 | SEQ ID NO. 4420 |
| (N20)NGG | 11 | 36596972 | + | GACTTTCAAGTTCATCTTCAGGG | 1 | 4 | 98 | SEQ ID NO. 4421 |
| (N20)NGG | 11 | 36596973 | + | ACTTTCAAGTTCATCTTCAGGGG | 1 | 7 | 69 | SEQ ID NO. 4422 |
| (N20)NGG | 11 | 36596979 | + | AAGTTCATCTTCAGGGGCACCGG | 1 | 3 | 35 | SEQ ID NO. 4423 |
| (N20)NGG | 11 | 36597001 | + | GCTATGATGAAAAACTTGTGCGG | 1 | 2 | 53 | SEQ ID NO. 4424 |
| (N20)NGG | 11 | 36597002 | + | CTATGATGAAAAACTTGTGCCGG | 1 | 2 | 42 | SEQ ID NO. 4425 |
| (N20)NGG | 11 | 36597008 | + | TGAAAAACTTGTGCGGGAAGTGG | 1 | 2 | 18 | SEQ ID NO. 4426 |
| (N20)NGG | 11 | 36597012 | + | AAACTTGTGCGGGAAGTGGAAGG | 1 | 1 | 20 | SEQ ID NO. 4427 |
| (N20)NGG | 11 | 36597020 | + | GCGGGAAGTGGAAGGCCTCGAGG | 1 | 1 | 27 | SEQ ID NO. 4428 |
| (N20)NGG | 11 | 36597027 | + | GTGGAAGGCCTCGAGGCTTCTGG | 1 | 1 | 17 | SEQ ID NO. 4429 |
| (N20)NGG | 11 | 36597068 | + | TCTTTGTGATGCCACCCGTCTGG | 1 | 2 | 16 | SEQ ID NO. 4430 |
| (N20)NGG | 11 | 36597125 | + | CAGAAGCCATGCTGAGAACCTGG | 3 | 7 | 92 | SEQ ID NO. 4431 |
| (N20)NGG | 11 | 36597137 | + | TGAGAACCTGGAACGTTATGAGG | 1 | 1 | 10 | SEQ ID NO. 4432 |
| (N20)NGG | 11 | 36597142 | + | ACCTGGAACGTTATGAGGTCTGG | 1 | 2 | 11 | SEQ ID NO. 4433 |
| (N20)NGG | 11 | 36597170 | + | CAACCCTTACCATGAGTCTGTGG | 1 | 1 | 19 | SEQ ID NO. 4434 |

| site_type | site_chr omosome | site_start_ nucleotide | site_s trand | target_site_sequence_with_NGG | genome_wide_ hits_with_1_ or_less_mism atches | genome_wide_ hits_with_2_ or_less_mism atches | genome_wide_ hits_with_3_ or_less_mism atches | |
|---|---|---|---|---|---|---|---|---|
| (N20)NGG | 11 | 36597181 | + | ATGAGTCTGTGGAAGAACTGCGG | | 1 | 4 | 75 SEQ ID NO. 4435 |
| (N20)NGG | 11 | 36597182 | + | TGAGTCTGTGGAAGAACTCCGGG | | 1 | 4 | 70 SEQ ID NO. 4436 |
| (N20)NGG | 11 | 36597187 | + | CTGTGGAAGAACTGCGGATCGG | | 1 | 1 | 26 SEQ ID NO. 4437 |
| (N20)NGG | 11 | 36597188 | + | TGTGGAAGAACTGCGGATCGGG | | 1 | 1 | 16 SEQ ID NO. 4438 |
| (N20)NGG | 11 | 36597195 | + | GAACTGCGGATCGGGTGAAAGG | | 1 | 1 | 29 SEQ ID NO. 4439 |
| (N20)NGG | 11 | 36597196 | + | AACTGCGGATCGGGTGAAAGGG | | 1 | 1 | 5 SEQ ID NO. 4440 |
| (N20)NGG | 11 | 36597197 | + | ACTGCGGATCGGGTGAAAGGGG | | 1 | 1 | 10 SEQ ID NO. 4441 |
| (N20)NGG | 11 | 36597258 | + | GATGCACTCCACTGTGACATTGG | | 1 | 2 | 33 SEQ ID NO. 4442 |
| (N20)NGG | 11 | 36597300 | + | AAGATCTTCCAGCTAGAGATAGG | | 1 | 3 | 39 SEQ ID NO. 4443 |
| (N20)NGG | 11 | 36597301 | + | AGATCTTCCAGCTAGAGATAGGG | | 1 | 6 | 55 SEQ ID NO. 4444 |
| (N20)NGG | 11 | 36597302 | + | GATCTTCCAGCTAGAGATAGGGG | | 2 | 5 | 50 SEQ ID NO. 4445 |
| (N20)NGG | 11 | 36597335 | + | GAATCCCAATGCTTCCAAAGAGG | | 1 | 2 | 31 SEQ ID NO. 4446 |
| (N20)NGG | 11 | 36597340 | + | CCAATGCTTCCAAAGAGGAAAGG | | 1 | 7 | 60 SEQ ID NO. 4447 |
| (N20)NGG | 11 | 36597346 | + | CTTCCAAAGAGGAAAGGAAAAGG | | 1 | 41 | 458 SEQ ID NO. 4448 |
| (N20)NGG | 11 | 36597349 | + | CCAAAGAGGAAAGGAAAAGGTGG | | 2 | 39 | 523 SEQ ID NO. 4449 |
| (N20)NGG | 11 | 36597353 | + | AGAGAAAGGAAAAGGTGCAGG | | 3 | 11 | 305 SEQ ID NO. 4450 |
| (N20)NGG | 11 | 36597362 | + | GAAAAGTGGCAGGCACAAGCATCTCCGG | | 1 | 5 | 53 SEQ ID NO. 4451 |
| (N20)NGG | 11 | 36597376 | + | CCACACTGGACAAGCATCTCCGG | | 1 | 3 | 24 SEQ ID NO. 4452 |
| (N20)NGG | 11 | 36597406 | + | TGAACCTCAAACCAATCATGAGG | | 1 | 1 | 35 SEQ ID NO. 4453 |
| (N20)NGG | 11 | 36597414 | + | AAACCAATCATGAGGATGAATGG | | 1 | 5 | 72 SEQ ID NO. 4454 |
| (N20)NGG | 11 | 36597427 | + | GGATGAATGGCAACTTTGCCAGG | | 1 | 3 | 24 SEQ ID NO. 4455 |
| (N20)NGG | 11 | 36597452 | + | GCTCATGACCAAAGAGACTGTGG | | 1 | 2 | 39 SEQ ID NO. 4456 |
| (N20)NGG | 11 | 36597482 | + | TTGTGAGTTAATTCCTTCCGAGG | | 1 | 1 | 16 SEQ ID NO. 4457 |
| (N20)NGG | 11 | 36597487 | + | AGTTAATTCCTTCCGAGGAGAGG | | 1 | 1 | 13 SEQ ID NO. 4458 |
| (N20)NGG | 11 | 36597494 | + | TCCTTCCGAGGAGGCACCAGG | | 1 | 1 | 28 SEQ ID NO. 4459 |
| (N20)NGG | 11 | 36597502 | + | AGGAGAGGCACGAGGCTCTGAGG | | 1 | 3 | 69 SEQ ID NO. 4460 |
| (N20)NGG | 11 | 36597503 | + | GGAGAGGCACGAGGCTCTGAGGG | | 1 | 1 | 43 SEQ ID NO. 4461 |
| (N20)NGG | 11 | 36597512 | + | CGAGGCTCTGAGGGAGCTCATGG | | 1 | 3 | 43 SEQ ID NO. 4462 |
| (N20)NGG | 11 | 36597541 | + | ACCTGAAGATGAAACCAGTATGG | | 1 | 3 | 36 SEQ ID NO. 4463 |
| (N20)NGG | 11 | 36597643 | + | TTTCTACGAAGTTCAAGTATAGG | | 1 | 2 | 51 SEQ ID NO. 4464 |
| (N20)NGG | 11 | 36597650 | + | GAAGTTCAAGTATAGGTATGAGG | | 2 | 3 | 35 SEQ ID NO. 4465 |
| (N20)NGG | 11 | 36597651 | + | AAGTTCAAGTATAGGTATGAGGG | | 1 | 3 | 35 SEQ ID NO. 4466 |
| (N20)NGG | 11 | 36597683 | + | CAATTATTTTCACAAAACCCTGG | | 1 | 5 | 94 SEQ ID NO. 4467 |

FIG. 13 cont.

| site type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 36597709 | + | ATGTTCCTGAAATTATTGAGAGG | 1 | 4 | 79 | SEQ ID NO. 4468 |
| (N20)NGG | 11 | 36597710 | + | TGTTCCTGAAATTATTGAGAGGG |  | 8 | 155 | SEQ ID NO. 4469 |
| (N20)NGG | 11 | 36597714 | + | CCTGAAATTATTGAGAGGGATGG | 1 | 2 | 50 | SEQ ID NO. 4470 |
| (N20)NGG | 11 | 36597723 | + | ATTGAGAGGGATGGCTCCATTGG | 1 | 2 | 17 | SEQ ID NO. 4471 |
| (N20)NGG | 11 | 36597724 | + | TTGAGAGGGATGGCTCCATTGGG | 1 | 1 | 17 | SEQ ID NO. 4472 |
| (N20)NGG | 11 | 36597725 | + | TGAGAGGGATGGCTCCATTGGGG | 1 | 4 | 41 | SEQ ID NO. 4473 |
| (N20)NGG | 11 | 36597730 | + | GGGATGGCTCCATTGGGCATGG | 1 | 4 | 21 | SEQ ID NO. 4474 |
| (N20)NGG | 11 | 36597731 | + | GGATGGCTCCATTGGGCATGGG | 1 | 1 | 19 | SEQ ID NO. 4475 |
| (N20)NGG | 11 | 36597740 | + | CATTGGGCATGGCAAGTGAGG | 1 | 3 | 33 | SEQ ID NO. 4476 |
| (N20)NGG | 11 | 36597741 | + | ATTGGGCATGGCAAGTGAGGG | 1 | 3 | 41 | SEQ ID NO. 4477 |
| (N20)NGG | 11 | 36597753 | + | GCAAGTGAGGGAAATGAGTCTGG | 1 | 5 | 114 | SEQ ID NO. 4478 |
| (N20)NGG | 11 | 36597769 | + | AGTCTGGTAACAAACTGTTTAGG | 1 | 4 | 43 | SEQ ID NO. 4479 |
| (N20)NGG | 11 | 36597778 | + | ACAAACTGTTTAGGCGCTTCCGG | 1 | 1 | 16 | SEQ ID NO. 4480 |
| (N20)NGG | 11 | 36597793 | + | GCTTCCGGAAAATGAATGCCAGG | 1 | 1 | 17 | SEQ ID NO. 4481 |
| (N20)NGG | 11 | 36597815 | + | GCAGTCCAAATGCTATGAGATGG | 1 | 3 | 34 | SEQ ID NO. 4482 |
| (N20)NGG | 11 | 36597838 | + | AAGATGTCCTGAAACACCACTGG | 1 | 1 | 36 | SEQ ID NO. 4483 |
| (N20)NGG | 11 | 36597900 | + | CATAATGCATTAAAAACCTCTGG | 1 | 3 | 60 | SEQ ID NO. 4484 |
| (N20)NGG | 11 | 36597901 | + | ATAATGCATTAAAAACCTCTGGG | 2 | 8 | 86 | SEQ ID NO. 4485 |
| (N20)NGG | 11 | 36597920 | + | TGGGTTTACCATGAACCCTCAGG | 1 | 3 | 17 | SEQ ID NO. 4486 |
| (N20)NGG | 11 | 36597930 | + | ATGAACCCTCAGGCAAGCTTAGG | 1 | 2 | 27 | SEQ ID NO. 4487 |
| (N20)NGG | 11 | 36597931 | + | TGAACCCTCAGGCAAGCTTAGGG | 1 | 1 | 17 | SEQ ID NO. 4488 |
| (N20)NGG | 11 | 36597932 | + | GAACCCTCAGGCAAGCTTAGGGG | 1 | 2 | 16 | SEQ ID NO. 4489 |
| (N20)NGG | 11 | 36597942 | + | GCAAGCTTAGGGGACCCATTAGG | 1 | 2 | 12 | SEQ ID NO. 4490 |
| (N20)NGG | 11 | 36597950 | + | AGGGGACCCATTAGGCATAGAGG | 2 | 3 | 22 | SEQ ID NO. 4491 |
| (N20)NGG | 11 | 36597959 | + | ATTAGGCATAGAGGACTCTCTGG | 1 | 1 | 20 | SEQ ID NO. 4492 |
| (N20)NGG | 11 | 36597977 | + | TCTGGAAAGCCAAGATTCAATGG | 1 | 7 | 61 | SEQ ID NO. 4493 |
| (N20)NGG | 11 | 36594861 | - | TCCCAAGGTGGGTGGGAAAGAGG | 1 | 6 | 90 | SEQ ID NO. 4494 |
| (N20)NGG | 11 | 36594868 | - | AACTGAGTCCCAAGGTGGGTGGG | 1 | 6 | 113 | SEQ ID NO. 4495 |
| (N20)NGG | 11 | 36594869 | - | GAACTGAGTCCCAAGGTGGGTGG | 2 | 6 | 82 | SEQ ID NO. 4496 |
| (N20)NGG | 11 | 36594872 | - | GCAGAACTGAGTCCCAAGGTGG | 1 | 4 | 61 | SEQ ID NO. 4497 |
| (N20)NGG | 11 | 36594873 | - | GGCAGAACTGAGTCCCAAGGTGG | 1 | 6 | 100 | SEQ ID NO. 4498 |
| (N20)NGG | 11 | 36594876 | - | TGGGGCAGAACTGAGTCCCAAGG | 1 | 5 | 98 | SEQ ID NO. 4499 |
| (N20)NGG | 11 | 36594894 | - | TGGGTGCTGAATTTCATCTGGGG | 2 | 8 | 65 | SEQ ID NO. 4500 |

FIG. 13 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 36594895 | - | GTGGGTGCTGAATTTCATCTGGG | 2 | 2 | 49 | SEQ ID NO. 4501 |
| (N20)NGG | 11 | 36594896 | - | TGTGGGTGCTGAATTTCATCTGG | 1 | 4 | 38 | SEQ ID NO. 4502 |
| (N20)NGG | 11 | 36594913 | - | ATTCTGAAAATTTAATATGTGGG | 1 | 22 | 290 | SEQ ID NO. 4503 |
| (N20)NGG | 11 | 36594914 | - | CATTCTGAAAATTTAATATGTGG | 3 | 11 | 173 | SEQ ID NO. 4504 |
| (N20)NGG | 11 | 36594952 | - | TCTTTTCAAAGGATCTCACCCGG | 1 | 2 | 51 | SEQ ID NO. 4505 |
| (N20)NGG | 11 | 36594963 | - | TTCTTCAGGTGTCTTTTCAAAGG | 2 | 12 | 161 | SEQ ID NO. 4506 |
| (N20)NGG | 11 | 36594977 | - | TTTTTCCTTTTGAGCTTCTTCAGG | 1 | 11 | 187 | SEQ ID NO. 4507 |
| (N20)NGG | 11 | 36595008 | - | CAGAGAGGGTTTCCCCTCAAAGG | 1 | 4 | 28 | SEQ ID NO. 4508 |
| (N20)NGG | 11 | 36595022 | - | GCTGGAGATTGCTCCAGAGAGGG | 1 | 4 | 56 | SEQ ID NO. 4509 |
| (N20)NGG | 11 | 36595023 | - | TGCTGGAGATTGCTCCAGAGAGG | 1 | 2 | 43 | SEQ ID NO. 4510 |
| (N20)NGG | 11 | 36595040 | - | TCAGCCTTGTCCAGGACTGCTGG | 1 | 4 | 49 | SEQ ID NO. 4511 |
| (N20)NGG | 11 | 36595048 | - | TCTGACCATCAGCCTTGTCCAGG | 2 | 2 | 47 | SEQ ID NO. 4512 |
| (N20)NGG | 11 | 36595073 | - | AACAATGGCTGAGTTGGGACTGG | 1 | 5 | 52 | SEQ ID NO. 4513 |
| (N20)NGG | 11 | 36595078 | - | CTTTTAACAATGGCTGAGTTGGG | 1 | 6 | 95 | SEQ ID NO. 4514 |
| (N20)NGG | 11 | 36595079 | - | GCTTTTAACAATGGCTGAGTTGG | 1 | 3 | 58 | SEQ ID NO. 4515 |
| (N20)NGG | 11 | 36595088 | - | TTAGGGTGGGCTTTTAACAATGG | 1 | 2 | 34 | SEQ ID NO. 4516 |
| (N20)NGG | 11 | 36595101 | - | TTTCTTTGAAAACTTAGGGTGGG | 1 | 13 | 130 | SEQ ID NO. 4517 |
| (N20)NGG | 11 | 36595102 | - | ATTTCTTTGAAAACTTAGGGTGG | 1 | 5 | 108 | SEQ ID NO. 4518 |
| (N20)NGG | 11 | 36595105 | - | GAAATTTCTTTGAAAACTTAGGG | 2 | 22 | 293 | SEQ ID NO. 4519 |
| (N20)NGG | 11 | 36595106 | - | TGAAATTTCTTTGAAAACTTAGG | 1 | 22 | 312 | SEQ ID NO. 4520 |
| (N20)NGG | 11 | 36595159 | - | GATGTCGAAGGTTGGCTTGATGG | 1 | 3 | 18 | SEQ ID NO. 4521 |
| (N20)NGG | 11 | 36595167 | - | GCGGCAGAGATGTCGAAGGTTGG | 1 | 1 | 6 | SEQ ID NO. 4522 |
| (N20)NGG | 11 | 36595171 | - | AGATGCGGCAGAGATGTCGAAGG | 1 | 2 | 15 | SEQ ID NO. 4523 |
| (N20)NGG | 11 | 36595186 | - | TAAAAGAATTCCCACAGATGCGG | 1 | 7 | 91 | SEQ ID NO. 4524 |
| (N20)NGG | 11 | 36595235 | - | CCATCCACAGGACCATGGACTGG | 1 | 5 | 75 | SEQ ID NO. 4525 |
| (N20)NGG | 11 | 36595240 | - | TTTTACCATCCACAGGACCATGG | 1 | 3 | 46 | SEQ ID NO. 4526 |
| (N20)NGG | 11 | 36595247 | - | CCTAGGGTTTTACCATCCACAGG | 1 | 2 | 16 | SEQ ID NO. 4527 |
| (N20)NGG | 11 | 36595263 | - | CTTCTTTTCGTAAAAGGCCTAGG | 1 | 5 | 27 | SEQ ID NO. 4528 |
| (N20)NGG | 11 | 36595264 | - | CCTTCTTTTCGTAAAAGGCCTAG | 1 | 1 | 19 | SEQ ID NO. 4529 |
| (N20)NGG | 11 | 36595270 | - | TCTTTTCTTCTTTTCGTAAAAGG | 1 | 10 | 194 | SEQ ID NO. 4530 |
| (N20)NGG | 11 | 36595302 | - | CTTGGCAATGAGGTCCGGCCAGG | 1 | 1 | 10 | SEQ ID NO. 4531 |
| (N20)NGG | 11 | 36595307 | - | AAAACCTTGGCAATGAGGTCCGG | 1 | 4 | 52 | SEQ ID NO. 4532 |
| (N20)NGG | 11 | 36595312 | - | TCCGAAAACCTTGGCAATGAGG | 1 | 1 | 12 | SEQ ID NO. 4533 |

FIG. 13 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 36595320 | - | CACATCGATCCGGAAAACCTTGG | 1 | 2 | 6 | SEQ ID NO. 4534 |
| (N20)NGG | 11 | 36595330 | - | CATCTGCCTTCACATCGATCCGG | 1 | 2 | 11 | SEQ ID NO. 4535 |
| (N20)NGG | 11 | 36595363 | - | TATGGCAGAACTCAGTGGGTGG | 1 | 1 | 59 | SEQ ID NO. 4536 |
| (N20)NGG | 11 | 36595366 | - | AGTTATGCAGAACTCAGTGGGG | 1 | 4 | 34 | SEQ ID NO. 4537 |
| (N20)NGG | 11 | 36595367 | - | CAGTTATGGCAGAACTCAGTGGG | 1 | 3 | 39 | SEQ ID NO. 4538 |
| (N20)NGG | 11 | 36595368 | - | GCAGTTATGGCAGAACTCAGTGG | 1 | 4 | 57 | SEQ ID NO. 4539 |
| (N20)NGG | 11 | 36595381 | - | GCATGATGCTCCAGCAGTTATGG | 1 | 1 | 19 | SEQ ID NO. 4540 |
| (N20)NGG | 11 | 36595422 | - | CGGGAAGTAAACCTCACATGGGG | 1 | 1 | 16 | SEQ ID NO. 4541 |
| (N20)NGG | 11 | 36595423 | - | TCGGGAAGTAAACCTCACATGG | 1 | 2 | 18 | SEQ ID NO. 4542 |
| (N20)NGG | 11 | 36595424 | - | CTCGGGAAGTAAACCTCACATGG | 1 | 3 | 16 | SEQ ID NO. 4543 |
| (N20)NGG | 11 | 36595441 | - | ACTCCATGTCACGTTCCTCGG | 1 | 5 | 19 | SEQ ID NO. 4544 |
| (N20)NGG | 11 | 36595442 | - | CACTCCATGTCACGTTCCTCG | 1 | 3 | 28 | SEQ ID NO. 4545 |
| (N20)NGG | 11 | 36595455 | - | TGTGTGGGGTGCCACTCCATGG | 1 | 4 | 35 | SEQ ID NO. 4546 |
| (N20)NGG | 11 | 36595468 | - | TGTCACAGGATGGTGTGTGGGG | 2 | 5 | 97 | SEQ ID NO. 4547 |
| (N20)NGG | 11 | 36595469 | - | ATGTCACAGGATGGTGTGTGGG | 1 | 5 | 63 | SEQ ID NO. 4548 |
| (N20)NGG | 11 | 36595470 | - | GATGTCACAGGATGGTGTGTGG | 1 | 4 | 48 | SEQ ID NO. 4549 |
| (N20)NGG | 11 | 36595471 | - | AGAGTCACAGGATGATGGTGTGG | 1 | 5 | 57 | SEQ ID NO. 4550 |
| (N20)NGG | 11 | 36595478 | - | GTGTTGCAGATGTCACAGGATGG | 1 | 8 | 106 | SEQ ID NO. 4551 |
| (N20)NGG | 11 | 36595482 | - | GGCAGTGTTGCAGATGTCACAGG | 2 | 2 | 39 | SEQ ID NO. 4552 |
| (N20)NGG | 11 | 36595503 | - | CTTCCTCTTGAGTCCCGACGG | 1 | 3 | 13 | SEQ ID NO. 4553 |
| (N20)NGG | 11 | 36595504 | - | TCTTCCTCTTGAGTCCCGACGG | 1 | 2 | 24 | SEQ ID NO. 4554 |
| (N20)NGG | 11 | 36595535 | - | TTTTTGCTGAGCTGCAAGTTTGG | 1 | 2 | 52 | SEQ ID NO. 4555 |
| (N20)NGG | 11 | 36595576 | - | GCTGACGGGCTTGTCTTGCTTGG | 1 | 3 | 74 | SEQ ID NO. 4556 |
| (N20)NGG | 11 | 36595590 | - | AGCTCTTCTTCTTGTGCTGACGG | 2 | 3 | 38 | SEQ ID NO. 4557 |
| (N20)NGG | 11 | 36595591 | - | GAGCTCTTCTTCTTGTGCTGACGG | 1 | 2 | 44 | SEQ ID NO. 4558 |
| (N20)NGG | 11 | 36595653 | - | AAGATGTATCTTACTGCAGTTGG | 1 | 2 | 43 | SEQ ID NO. 4559 |
| (N20)NGG | 11 | 36595680 | - | GAAGTCCACTGCAAGGAGCTTGG | 1 | 3 | 26 | SEQ ID NO. 4560 |
| (N20)NGG | 11 | 36595687 | - | GCTCTGGGAAGTCCACTGCAAGG | 1 | 4 | 41 | SEQ ID NO. 4561 |
| (N20)NGG | 11 | 36595702 | - | TGGATTTCACAAAGTGCTCTGGG | 1 | 2 | 66 | SEQ ID NO. 4562 |
| (N20)NGG | 11 | 36595703 | - | ATGGATTTCACAAAGTGCTCTGG | 1 | 3 | 41 | SEQ ID NO. 4563 |
| (N20)NGG | 11 | 36595722 | - | TTCACAGATCGGCAGGAGATGG | 1 | 13 | 151 | SEQ ID NO. 4564 |
| (N20)NGG | 11 | 36595728 | - | AATGTGTTCACAGATCTGGCAGG | 1 | 4 | 43 | SEQ ID NO. 4565 |
| (N20)NGG | 11 | 36595732 | - | CCAGAATGTGTTCACAGATCTGG | 2 | 6 | 47 | SEQ ID NO. 4566 |

FIG. 13 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 36595759 | - | GCTTACAGTTGGTCTCCACAGGG | 1 | 1 | 23 | SEQ ID NO. 4567 |
| (N20)NGG | 11 | 36595760 | - | TGCTTACAGTTGGTCTCCACAGG | | 1 | 20 | SEQ ID NO. 4568 |
| (N20)NGG | 11 | 36595770 | - | GCAAAAGACATGCTTACAGTTGG | | 2 | 51 | SEQ ID NO. 4569 |
| (N20)NGG | 11 | 36595792 | - | GGCATCTGAGAATGCAGACCCGG | | 5 | 50 | SEQ ID NO. 4570 |
| (N20)NGG | 11 | 36595813 | - | AATAGCTGCCCATGACTTTGAGG | | 7 | 48 | SEQ ID NO. 4571 |
| (N20)NGG | 11 | 36595838 | - | AAGCATGATATCGGCAAGAGGG | 1 | 1 | 23 | SEQ ID NO. 4572 |
| (N20)NGG | 11 | 36595839 | - | GAAGCATGGATATCGGCAAGAGG | | 2 | 22 | SEQ ID NO. 4573 |
| (N20)NGG | 11 | 36595846 | - | CAGTAGGGAAGCATGGATATCGG | 1 | 2 | 47 | SEQ ID NO. 4574 |
| (N20)NGG | 11 | 36595853 | - | TCCAGGTCAGTAGGGAAGCATGG | 1 | 5 | 59 | SEQ ID NO. 4575 |
| (N20)NGG | 11 | 36595861 | - | CTGGACTTCCAGGTCAGTAGGG | 1 | 3 | 39 | SEQ ID NO. 4576 |
| (N20)NGG | 11 | 36595862 | - | ACTGGACTCTCCAGGTCAGTAGG | 2 | 5 | 17 | SEQ ID NO. 4577 |
| (N20)NGG | 11 | 36595870 | - | AGGACTTCACTGGACTCTCCAGG | 1 | 3 | 35 | SEQ ID NO. 4578 |
| (N20)NGG | 11 | 36595880 | - | ACGCTCAGAAAGGACTTCACTGG | 1 | 1 | 22 | SEQ ID NO. 4579 |
| (N20)NGG | 11 | 36595890 | - | GGAATTCAAGACGCTCAGAAAGG | 1 | 1 | 23 | SEQ ID NO. 4580 |
| (N20)NGG | 11 | 36595911 | - | TGCTGGACATTTCACCATCAGGG | 1 | 3 | 48 | SEQ ID NO. 4581 |
| (N20)NGG | 11 | 36595912 | - | TTGCTGGACATTTCACCATCAGG | 1 | 2 | 30 | SEQ ID NO. 4582 |
| (N20)NGG | 11 | 36595928 | - | TCCTCATTGACTCTTTTGCTGG | 1 | 3 | 33 | SEQ ID NO. 4583 |
| (N20)NGG | 11 | 36595975 | - | ATTCCTTGTGACTTGAGATGTGG | 1 | 3 | 32 | SEQ ID NO. 4584 |
| (N20)NGG | 11 | 36596032 | - | ACAGAAGATGTTGGCGGGGCCGG | 1 | 2 | 60 | SEQ ID NO. 4585 |
| (N20)NGG | 11 | 36596036 | - | AGCGACAGAAGATGTTGGCGGGG | 1 | 2 | 21 | SEQ ID NO. 4586 |
| (N20)NGG | 11 | 36596037 | - | CAGCGACAGAAGATGTTGGCGGG | 1 | 2 | 23 | SEQ ID NO. 4587 |
| (N20)NGG | 11 | 36596038 | - | TCAGCGACAGAAGATGTTGGCGG | 1 | 2 | 30 | SEQ ID NO. 4588 |
| (N20)NGG | 11 | 36596041 | - | GAGTCAGCGACAGAAGATGTTGG | 1 | 8 | 54 | SEQ ID NO. 4589 |
| (N20)NGG | 11 | 36596080 | - | GCAGCTTGAGCTCCCTCAGCCGG | 1 | 3 | 40 | SEQ ID NO. 4590 |
| (N20)NGG | 11 | 36596112 | - | ACCTTCTTCTTTGTCAGCACAGG | 1 | 4 | 50 | SEQ ID NO. 4591 |
| (N20)NGG | 11 | 36596148 | - | CAGGAACAAGTCATGCAGGAACAAGG | 1 | 4 | 56 | SEQ ID NO. 4592 |
| (N20)NGG | 11 | 36596160 | - | CCTCAGAGCCAGCAGGAACAAGG | 2 | 19 | 201 | SEQ ID NO. 4593 |
| (N20)NGG | 11 | 36596167 | - | TCCTGCCCTCAGAGCCAGCAGG | 1 | 2 | 41 | SEQ ID NO. 4594 |
| (N20)NGG | 11 | 36596220 | - | AGAGCCCTTTCCCTGCATGATGG | 1 | 1 | 46 | SEQ ID NO. 4595 |
| (N20)NGG | 11 | 36596245 | - | CCAAGCAAAACAGCTGGCTGCAGG | 3 | 4 | 45 | SEQ ID NO. 4596 |
| (N20)NGG | 11 | 36596252 | - | CGGATGGCCAAGCAAAACAGCTGG | 1 | 1 | 16 | SEQ ID NO. 4597 |
| (N20)NGG | 11 | 36596268 | - | GAGGAAGGTGTTGACACGGATGG | 1 | 3 | 37 | SEQ ID NO. 4598 |
| (N20)NGG | 11 | 36596272 | - | AGCTGAGGAAGGTGTTGACACGG | 1 | 5 | 72 | SEQ ID NO. 4599 |

FIG. 13 cont.

| site type | site_chr omosome | site_start_ nucleotide | site_s trand | target_site_sequence_with_NGG | genome_wide_hits_with_1_or_less_mism atches | genome_wide_hits_with_2_or_less_mism atches | genome_wide_hits_with_3_or_less_mism atches | |
|---|---|---|---|---|---|---|---|---|
| (N20)NGG | 11 | 36596283 | - | GTACTGACTGCAGCTGAGGAAGG | 1 | 7 | 57 | SEQ ID NO. 4600 |
| (N20)NGG | 11 | 36596287 | - | TGTGCTACTGACTGCAGCTGAGG | 1 | 5 | 65 | SEQ ID NO. 4601 |
| (N20)NGG | 11 | 36596305 | - | TCACAGTCCTGTACATCTTGTGG | 1 | 2 | 36 | SEQ ID NO. 4602 |
| (N20)NGG | 11 | 36596331 | - | AAAAATCTGTCTCCCTGTGATGG | 1 | 2 | 100 | SEQ ID NO. 4603 |
| (N20)NGG | 11 | 36596357 | - | GCATTCCGAAGGGCATGCAAAGG | 1 | 1 | 10 | SEQ ID NO. 4604 |
| (N20)NGG | 11 | 36596367 | - | TACCTTCTCAGCATTCCGAAGGG | 1 | 1 | 35 | SEQ ID NO. 4605 |
| (N20)NGG | 11 | 36596368 | - | GTACCTTCTCAGCATTCCGAAGG | 1 | 1 | 11 | SEQ ID NO. 4606 |
| (N20)NGG | 11 | 36596396 | - | CACTCAAAGTGGTGGTAGCCTGG | 2 | 3 | 19 | SEQ ID NO. 4607 |
| (N20)NGG | 11 | 36596404 | - | GTGGCTGCCACTCAAAGTGTGG | 1 | 1 | 30 | SEQ ID NO. 4608 |
| (N20)NGG | 11 | 36596407 | - | GAGGTGGCTGCCACTCAAAGTGG | 1 | 5 | 53 | SEQ ID NO. 4609 |
| (N20)NGG | 11 | 36596423 | - | GAAGACACATTCTTCAGAGGTGG | 1 | 4 | 82 | SEQ ID NO. 4610 |
| (N20)NGG | 11 | 36596426 | - | CTGGAAGACACATTCTTCAGAGG | 2 | 5 | 70 | SEQ ID NO. 4611 |
| (N20)NGG | 11 | 36596445 | - | AATAATGCCAACATCAGTCTCGG | 1 | 4 | 41 | SEQ ID NO. 4612 |
| (N20)NGG | 11 | 36596490 | - | CACTGGGTAATCATCCACAGAGG | 2 | 2 | 27 | SEQ ID NO. 4613 |
| (N20)NGG | 11 | 36596506 | - | TCTTTGCAATGGTGTCCACTGGG | 1 | 5 | 24 | SEQ ID NO. 4614 |
| (N20)NGG | 11 | 36596507 | - | CTCTTTGCAATGGTGTCCACTGG | 1 | 2 | 24 | SEQ ID NO. 4615 |
| (N20)NGG | 11 | 36596517 | - | ATAGCGGAACCTCTTTGCAATGG | 1 | 1 | 10 | SEQ ID NO. 4616 |
| (N20)NGG | 11 | 36596533 | - | ACACCAAAGCTGAATCATAGCGG | 1 | 2 | 35 | SEQ ID NO. 4617 |
| (N20)NGG | 11 | 36596601 | - | CAGGTAATCATCAAGGTCTTGGG | 1 | 1 | 26 | SEQ ID NO. 4618 |
| (N20)NGG | 11 | 36596602 | - | TCAGGTAATCATCAAGGTCTTGG | 1 | 3 | 33 | SEQ ID NO. 4619 |
| (N20)NGG | 11 | 36596608 | - | GGCCATTCAGGTAATCATCAAGG | 1 | 1 | 17 | SEQ ID NO. 4620 |
| (N20)NGG | 11 | 36596620 | - | CCAGAGTGAAGGGGCCATTCAGG | 1 | 3 | 33 | SEQ ID NO. 4621 |
| (N20)NGG | 11 | 36596629 | - | CCTTTCACCACCAGTGAAGGGG | 1 | 3 | 62 | SEQ ID NO. 4622 |
| (N20)NGG | 11 | 36596630 | - | TCCTTCACCACCACAGTGAAGG | 1 | 2 | 52 | SEQ ID NO. 4623 |
| (N20)NGG | 11 | 36596631 | - | CTCCTTCACCACCACAGTGAAGG | 1 | 5 | 79 | SEQ ID NO. 4624 |
| (N20)NGG | 11 | 36596699 | - | ACTGCCTTTTCTGGAACTACAGG | 2 | 2 | 53 | SEQ ID NO. 4625 |
| (N20)NGG | 11 | 36596708 | - | GAAAAACGGACTGCCTTTTCTGG | 1 | 1 | 27 | SEQ ID NO. 4626 |
| (N20)NGG | 11 | 36596722 | - | TCATGATTGTGAATGAAAAACGG | 1 | 8 | 141 | SEQ ID NO. 4627 |
| (N20)NGG | 11 | 36596757 | - | TTTCACATTCTGAGAGCTGTGG | 1 | 4 | 66 | SEQ ID NO. 4628 |
| (N20)NGG | 11 | 36596758 | - | CTTTCACATTCTGAGAGCTGTGG | 3 | 9 | 85 | SEQ ID NO. 4629 |
| (N20)NGG | 11 | 36596793 | - | ACACAGTTCAGAGTTAGGTTTGG | 1 | 4 | 32 | SEQ ID NO. 4630 |
| (N20)NGG | 11 | 36596798 | - | TTGCAACACAGTTCAGAGTTAGG | 2 | 11 | 62 | SEQ ID NO. 4631 |
| (N20)NGG | 11 | 36596822 | - | TCTGCCAGCATAAGGCACAATGG | 1 | 2 | 34 | SEQ ID NO. 4632 |

FIG. 13 cont.

| site_type | site_chr onosome | site_start nucleotide | site strand | target_site_sequence with h NGG | genome_wide_ hits_with_1_ or_less_mism atches | genome_wide_ hits_with_2_ or_less_mism atches | genome_wide_ hits_with_3_ or_less_mism atches | |
|---|---|---|---|---|---|---|---|---|
| (N20)NGG | 11 | 36596830 | - | CAGACTCATCTGCCAGCATAAGG | 1 | 1 | 36 | SEQ ID NO. 4633 |
| (N20)NGG | 11 | 36596854 | - | GGATGGCAGTCAGCGTCTCGTGG | 1 | 3 | 11 | SEQ ID NO. 4634 |
| (N20)NGG | 11 | 36596871 | - | AGCAATGAGAGGACTCAGGATGG | 1 | 5 | 97 | SEQ ID NO. 4635 |
| (N20)NGG | 11 | 36596875 | - | TCTCAGCAATGAGAGGACTCAGG | 1 | 2 | 55 | SEQ ID NO. 4636 |
| (N20)NGG | 11 | 36596882 | - | GCCTCCCTCTCAGCAATGAGAGG | 1 | 2 | 42 | SEQ ID NO. 4637 |
| (N20)NGG | 11 | 36596904 | - | CATTAATTCACTGCTCTTCATGG | 1 | 4 | 108 | SEQ ID NO. 4638 |
| (N20)NGG | 11 | 36596947 | - | TGAAGATGAACTTGAAAGTCCGG | 1 | 2 | 94 | SEQ ID NO. 4639 |
| (N20)NGG | 11 | 36596976 | - | CACAAGTTTTTCATCATAGCCGG | 1 | 1 | 28 | SEQ ID NO. 4640 |
| (N20)NGG | 11 | 36597013 | - | AGACTGAGCCAGAAAGCCTCAGG | 1 | 3 | 42 | SEQ ID NO. 4641 |
| (N20)NGG | 11 | 36597057 | - | TTGAGAGGCTTCCAGACGGGTGG | 1 | 3 | 30 | SEQ ID NO. 4642 |
| (N20)NGG | 11 | 36597060 | - | ATTTTGAGAGGCTTCCAGACGGG | 1 | 4 | 31 | SEQ ID NO. 4643 |
| (N20)NGG | 11 | 36597061 | - | GATTTTGAGAGGCTTCCAGACGG | 1 | 5 | 64 | SEQ ID NO. 4644 |
| (N20)NGG | 11 | 36597072 | - | GTGGAAGACAAGATTTTGAGAGG | 1 | 3 | 81 | SEQ ID NO. 4645 |
| (N20)NGG | 11 | 36597091 | - | CATGGCTTCTGTTATAGAGTGG | 1 | 6 | 44 | SEQ ID NO. 4646 |
| (N20)NGG | 11 | 36597102 | - | CAGGTTCTCAGCATGGCTTCTGG | 1 | 5 | 76 | SEQ ID NO. 4647 |
| (N20)NGG | 11 | 36597109 | - | AACGTTCCAGGTTCTCAGCATGG | 1 | 3 | 20 | SEQ ID NO. 4648 |
| (N20)NGG | 11 | 36597121 | - | GCCAGACCTCATAACGTTCCAGG | 1 | 1 | 11 | SEQ ID NO. 4649 |
| (N20)NGG | 11 | 36597147 | - | CACAGACTCATGGTAAGGTTGG | 1 | 2 | 29 | SEQ ID NO. 4650 |
| (N20)NGG | 11 | 36597151 | - | CTTCCACAGACTCATGGTAAGG | 1 | 5 | 41 | SEQ ID NO. 4651 |
| (N20)NGG | 11 | 36597152 | - | TCTTCCACAGACTCATGGTAAGG | 1 | 5 | 38 | SEQ ID NO. 4652 |
| (N20)NGG | 11 | 36597157 | - | GCAGTTCTTCCACAGACTCATGG | 1 | 5 | 54 | SEQ ID NO. 4653 |
| (N20)NGG | 11 | 36597209 | - | GAAGGGACTGTCTCAATGAAAGG | 1 | 3 | 40 | SEQ ID NO. 4654 |
| (N20)NGG | 11 | 36597226 | - | AGTGGAGTGCATCTATGGAAGG | 1 | 2 | 31 | SEQ ID NO. 4655 |
| (N20)NGG | 11 | 36597227 | - | CAGTGGAGTGCATCTATGGAAGG | 1 | 2 | 21 | SEQ ID NO. 4656 |
| (N20)NGG | 11 | 36597231 | - | GTCACAGTGGAGTGCATCTATGG | 1 | 9 | 59 | SEQ ID NO. 4657 |
| (N20)NGG | 11 | 36597244 | - | CTGCATTGCCAATGTCACAGTGG | 1 | 5 | 50 | SEQ ID NO. 4658 |
| (N20)NGG | 11 | 36597286 | - | ACACTTCCCCTATCTCTAGCTGG | 1 | 1 | 24 | SEQ ID NO. 4659 |
| (N20)NGG | 11 | 36597317 | - | CTTTCCTCTTTGGAAGCATTGGG | 1 | 7 | 102 | SEQ ID NO. 4660 |
| (N20)NGG | 11 | 36597318 | - | CCCTTTCCTCTTTGGAAGCATTGG | 1 | 3 | 74 | SEQ ID NO. 4661 |
| (N20)NGG | 11 | 36597327 | - | CCACCTTTTCCTCTTCCTCTTTGG | 3 | 18 | 318 | SEQ ID NO. 4662 |
| (N20)NGG | 11 | 36597354 | - | CCGAGATGCTTGTCCAGTGTGG | 1 | 1 | 11 | SEQ ID NO. 4663 |
| (N20)NGG | 11 | 36597373 | - | GTTTGAGGTTCATCTTCTTCCGG | 1 | 5 | 47 | SEQ ID NO. 4664 |
| (N20)NGG | 11 | 36597388 | - | TCATCCTCATGATTGGTTTGAGG | 1 | 3 | 36 | SEQ ID NO. 4665 |

FIG. 13 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 36597395 | - | TTGCCATTCATCCTCATGATTGG |   | 2 | 34 | SEQ ID NO. 4666 |
| (N20)NGG | 11 | 36597423 | - | CTCTTTGGTCATGAGCTTCCTGG | 1 | 5 | 59 | SEQ ID NO. 4667 |
| (N20)NGG | 11 | 36597438 | - | AACTGCATCCACAGTCTCTTTGG | 1 | 6 | 70 | SEQ ID NO. 4668 |
| (N20)NGG | 11 | 36597473 | - | GCCTCGTGCCTCTCCTCGGAAGG | 1 | 3 | 21 | SEQ ID NO. 4669 |
| (N20)NGG | 11 | 36597477 | - | CAGAGCCTCGTGCCTCTCCTCGG | 1 | 4 | 45 | SEQ ID NO. 4670 |
| (N20)NGG | 11 | 36597520 | - | GCCATACTGGTTTCATCTTCAGG | 1 | 1 | 32 | SEQ ID NO. 4671 |
| (N20)NGG | 11 | 36597533 | - | GGGCATGATGATCGCCATACTGG | 1 | 2 | 5 | SEQ ID NO. 4672 |
| (N20)NGG | 11 | 36597553 | - | ATTCTGGGCACTCTTTAGCAGGG | 1 | 2 | 35 | SEQ ID NO. 4673 |
| (N20)NGG | 11 | 36597554 | - | GATTCTGGGCACTCTTTAGCAGG | 2 | 4 | 32 | SEQ ID NO. 4674 |
| (N20)NGG | 11 | 36597568 | - | TGTACTGGCAGAGGGATTCTGGG | 1 | 2 | 31 | SEQ ID NO. 4675 |
| (N20)NGG | 11 | 36597569 | - | CTGTACTGGCAGAGGGATTCTGG | 1 | 1 | 23 | SEQ ID NO. 4676 |
| (N20)NGG | 11 | 36597576 | - | ATTGAAACTGTACTGGCAGAGGG | 1 | 3 | 38 | SEQ ID NO. 4677 |
| (N20)NGG | 11 | 36597577 | - | AATTGAAACTGTACTGGCAGAGG | 1 | 7 | 44 | SEQ ID NO. 4678 |
| (N20)NGG | 11 | 36597583 | - | GCTGTGAATTGAAACTGTACTGG | 1 | 1 | 19 | SEQ ID NO. 4679 |
| (N20)NGG | 11 | 36597619 | - | TATACTTGAACTTCGTAGAAAGG | 1 | 1 | 37 | SEQ ID NO. 4680 |
| (N20)NGG | 11 | 36597660 | - | CAGGGTTTTGTGAAAATAATTGG | 1 | 7 | 98 | SEQ ID NO. 4681 |
| (N20)NGG | 11 | 36597678 | - | AATTTCAGGAACATGGGCCAGG | 1 | 4 | 44 | SEQ ID NO. 4682 |
| (N20)NGG | 11 | 36597679 | - | TAATTTCAGGAACATGGGCCAGG | 1 | 3 | 36 | SEQ ID NO. 4683 |
| (N20)NGG | 11 | 36597684 | - | CTCAATAATTTCAGGAACATGGG | 1 | 4 | 74 | SEQ ID NO. 4684 |
| (N20)NGG | 11 | 36597685 | - | TCTCAATAATTTCAGGAACATGG | 1 | 9 | 114 | SEQ ID NO. 4685 |
| (N20)NGG | 11 | 36597692 | - | CCATCCCTCTTCAATAATTTCAG | 1 | 2 | 35 | SEQ ID NO. 4686 |
| (N20)NGG | 11 | 36597717 | - | CTTCACTTGCCCATGCCCCAATGG | 1 | 3 | 38 | SEQ ID NO. 4687 |
| (N20)NGG | 11 | 36597775 | - | ACTGCCTGGCATTCATTTTCCGG | 1 | 4 | 45 | SEQ ID NO. 4688 |
| (N20)NGG | 11 | 36597789 | - | CTCATAGCATTTGGACTGCCTGG | 1 | 1 | 18 | SEQ ID NO. 4689 |
| (N20)NGG | 11 | 36597798 | - | ATCTTCCATCTCATAGCATTTGG | 1 | 4 | 51 | SEQ ID NO. 4690 |
| (N20)NGG | 11 | 36597823 | - | TGTACAACCAGTTGGTGTTTCAG | 1 | 1 | 24 | SEQ ID NO. 4691 |
| (N20)NGG | 11 | 36597832 | - | ATTTGGAGGTGTACAACCAGTGG | 1 | 1 | 24 | SEQ ID NO. 4692 |
| (N20)NGG | 11 | 36597846 | - | AAACTTCTGGAGGTATTTGGAGG | 1 | 6 | 76 | SEQ ID NO. 4693 |
| (N20)NGG | 11 | 36597849 | - | CATAAACTTCTGGAGGTATTTGG | 1 | 2 | 42 | SEQ ID NO. 4694 |
| (N20)NGG | 11 | 36597856 | - | GAGCATTCATAAACTTCTGGAGG | 1 | 5 | 79 | SEQ ID NO. 4695 |
| (N20)NGG | 11 | 36597859 | - | TATGAGCATTCATAAACTTCTGG | 1 | 4 | 38 | SEQ ID NO. 4696 |
| (N20)NGG | 11 | 36597894 | - | AGGGTTCATGTAAACCCAGAGG | 1 | 6 | 39 | SEQ ID NO. 4697 |
| (N20)NGG | 11 | 36597906 | - | TAAGCTTGCCTGAGGGTTCATGG | 1 | 1 | 25 | SEQ ID NO. 4698 |

FIG. 13 cont.

| site_type | site_chr omosome | site_start_ nucleotide | site_s trand | target_site_sequence_with NGG | genome_wide_ hits_with_1_ or_less_mism atches | genome_wide_ hits_with_2_ or_less_mism atches | genome_wide_ hits_with_3_ or_less_mism atches | | |
|---|---|---|---|---|---|---|---|---|---|
| (N20)NGG | 11 | 36597913 | - | GGTCCCCTAAGCTTGCCTGAGGG | 1 | 2 | 21 | SEQ ID NO. | 4699 |
| (N20)NGG | 11 | 36597914 | - | GGGTCCCCTAAGCTTGCCTGAGG | 1 | 3 | 18 | SEQ ID NO. | 4700 |
| (N20)NGG | 11 | 36597934 | - | GAGAGTCCTCTATGCCTAATGGG | 1 | 1 | 9 | SEQ ID NO. | 4701 |
| (N20)NGG | 11 | 36597935 | - | AGAGAGTCCTCTATGCCTAATGG | 1 | 3 | 21 | SEQ ID NO. | 4702 |

FIG. 13 cont.

| site_type | site_chr omosome | site_start_ nucleotide | site_s trand | target_site_sequence_wi th_NGG | genome_wide_ hits_with_1_ or_less_mism atches | genome_wide_ hits_with_2_ or_less_mism atches | genome_wide_ hits_with_3_ or_less_mism atches | | |
|---|---|---|---|---|---|---|---|---|---|
| (N20)NGG | 11 | 36614186 | + | AACATAGCCTTAATTCAGCCAGG | 1 | 3 | 29 | SEQ ID NO. | 4703 |
| (N20)NGG | 11 | 36614210 | + | TTCTCACTGATGAATTTTGATGG | 1 | 24 | 221 | SEQ ID NO. | 4704 |
| (N20)NGG | 11 | 36614228 | + | GATGGACAAGTTTTCTTCTTTGG | 1 | 4 | 80 | SEQ ID NO. | 4705 |
| (N20)NGG | 11 | 36614237 | + | GTTTTCTTCTTGGACAAAAAGG | 1 | 13 | 170 | SEQ ID NO. | 4706 |
| (N20)NGG | 11 | 36614241 | + | TCTTCTTTGGACAAAAGGCTGG | 1 | 8 | 67 | SEQ ID NO. | 4707 |
| (N20)NGG | 11 | 36614264 | + | CCCAAAAGATCTGCCCCACTGG | 1 | 3 | 46 | SEQ ID NO. | 4708 |
| (N20)NGG | 11 | 36614278 | + | CCCCACTGGAGTTTTCCATCTGG | 1 | 4 | 38 | SEQ ID NO. | 4709 |
| (N20)NGG | 11 | 36614326 | + | GAAGCCTACAATTTTCTCTAAGG | 1 | 5 | 38 | SEQ ID NO. | 4710 |
| (N20)NGG | 11 | 36614378 | + | CCAGCCACTTGCACATTCAAAGG | 1 | 3 | 30 | SEQ ID NO. | 4711 |
| (N20)NGG | 11 | 36614386 | + | TTGCACATTCAAAGGCAGCTTGG | 2 | 3 | 40 | SEQ ID NO. | 4712 |
| (N20)NGG | 11 | 36614417 | + | AAGCATCAATACATCATCCATGG | 1 | 2 | 28 | SEQ ID NO. | 4713 |
| (N20)NGG | 11 | 36614420 | + | CATCAATACATCATCCATGGAGG | 1 | 1 | 22 | SEQ ID NO. | 4714 |
| (N20)NGG | 11 | 36614421 | + | ATCAATACATCATCCATGGAGGG | 1 | 3 | 30 | SEQ ID NO. | 4715 |
| (N20)NGG | 11 | 36614440 | + | AGGGAAAACACCAAACAATGAGG | 1 | 3 | 105 | SEQ ID NO. | 4716 |
| (N20)NGG | 11 | 36614491 | + | TGTTTGCAAGAACAACAAAAGG | 1 | 16 | 224 | SEQ ID NO. | 4717 |
| (N20)NGG | 11 | 36614521 | + | TCGCTGCACAGAGAAAGACTTGG | 1 | 2 | 30 | SEQ ID NO. | 4718 |
| (N20)NGG | 11 | 36614525 | + | TGCACAGAGAAAGACTTGGTAGG | 1 | 4 | 54 | SEQ ID NO. | 4719 |
| (N20)NGG | 11 | 36614549 | + | GATGTTCCTGAAGCCAGATATGG | 1 | 8 | 46 | SEQ ID NO. | 4720 |
| (N20)NGG | 11 | 36614566 | + | ATATGGTCATTCCATTAATGTGG | 1 | 4 | 45 | SEQ ID NO. | 4721 |
| (N20)NGG | 11 | 36614579 | + | ATTAATGTGGTGTACAGCCGAGG | 1 | 1 | 8 | SEQ ID NO. | 4722 |
| (N20)NGG | 11 | 36614580 | + | TTAATGTGGTGTACAGCCGAGGG | 1 | 1 | 11 | SEQ ID NO. | 4723 |
| (N20)NGG | 11 | 36614590 | + | GTACAGCCGAGGGAAAAGTATGG | 1 | 5 | 223 | SEQ ID NO. | 4724 |
| (N20)NGG | 11 | 36614591 | + | TACAGCCGAGGGAAAAGTATGGG | 1 | 2 | 20 | SEQ ID NO. | 4725 |
| (N20)NGG | 11 | 36614603 | + | AAAAGTATGGGTGTTCTCTTTGG | 1 | 2 | 60 | SEQ ID NO. | 4726 |
| (N20)NGG | 11 | 36614606 | + | AGTATGGGTGTTCTCTTTGGAGG | 1 | 2 | 40 | SEQ ID NO. | 4727 |
| (N20)NGG | 11 | 36614649 | + | CCCACAGAACCACAGAAAAATGG | 3 | 11 | 170 | SEQ ID NO. | 4728 |
| (N20)NGG | 11 | 36614686 | + | CTGCCTGCCCTGTGTTTTCCTGG | 1 | 8 | 106 | SEQ ID NO. | 4729 |
| (N20)NGG | 11 | 36614689 | + | CCTGCCCTGTGTTTTCCTGGTGG | 1 | 8 | 117 | SEQ ID NO. | 4730 |
| (N20)NGG | 11 | 36614702 | + | TTCCTGGTGGATTTTGAATTTGG | 1 | 3 | 72 | SEQ ID NO. | 4731 |
| (N20)NGG | 11 | 36614703 | + | TCCTGGTGGATTTTGAATTTGGG | 1 | 7 | 123 | SEQ ID NO. | 4732 |
| (N20)NGG | 11 | 36614737 | + | ATACATTCTTCCAGAACTTCAGG | 1 | 5 | 73 | SEQ ID NO. | 4733 |
| (N20)NGG | 11 | 36614741 | + | ATTCTTCCAGAACTTCAGGATGG | 1 | 4 | 73 | SEQ ID NO. | 4734 |
| (N20)NGG | 11 | 36614742 | + | TTCTTCCAGAACTTCAGGATGGG | 1 | 4 | 69 | SEQ ID NO. | 4735 |

FIG. 14

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 36614792 | + | AATGACACCATCTATATTTTAGG | 1 | 18 | 113 | SEQ ID NO. 4736 |
| (N20)NGG | 11 | 36614795 | + | GACACCATCTATATTTTAGGAGG | 1 | 3 | 49 | SEQ ID NO. 4737 |
| (N20)NGG | 11 | 36614820 | + | ATTCACTTGCCAATATATATCCGG | 1 | 2 | 47 | SEQ ID NO. 4738 |
| (N20)NGG | 11 | 36614844 | + | CTGCCAACCTGTACAGAATAAGG | 1 | 3 | 42 | SEQ ID NO. 4739 |
| (N20)NGG | 11 | 36614845 | + | TGCCAACCTGTACAGAATAAGGG | 1 | 2 | 36 | SEQ ID NO. 4740 |
| (N20)NGG | 11 | 36614860 | + | AATAAGGGTTGATCTTCCCCTGG | 1 | 2 | 22 | SEQ ID NO. 4741 |
| (N20)NGG | 11 | 36614861 | + | ATAAGGGTTGATCTTCCCCTGGG | 1 | 1 | 27 | SEQ ID NO. 4742 |
| (N20)NGG | 11 | 36614894 | + | GTGAATTGCACAGTCTTGCCAGG | 1 | 2 | 25 | SEQ ID NO. 4743 |
| (N20)NGG | 11 | 36614897 | + | AATTGCACAGTCTTGCCAGGAGG | 1 | 5 | 39 | SEQ ID NO. 4744 |
| (N20)NGG | 11 | 36614957 | + | AATGATGAATTTGTTATTGTTGG | 2 | 8 | 158 | SEQ ID NO. 4745 |
| (N20)NGG | 11 | 36614960 | + | GATGAATTTGTTATTGTTGGTGG | 1 | 6 | 90 | SEQ ID NO. 4746 |
| (N20)NGG | 11 | 36615013 | + | CTGCAACATCATCTCTTTAGAGG | 1 | 5 | 78 | SEQ ID NO. 4747 |
| (N20)NGG | 11 | 36615040 | + | CAAGATAGAAATTCGTGAGATGG | 1 | 5 | 34 | SEQ ID NO. 4748 |
| (N20)NGG | 11 | 36615054 | + | GTGAGATGGAGACCCCAGATTGG | 1 | 1 | 40 | SEQ ID NO. 4749 |
| (N20)NGG | 11 | 36615084 | + | ACATTAAGCACAGCAAGATATGG | 1 | 7 | 62 | SEQ ID NO. 4750 |
| (N20)NGG | 11 | 36615089 | + | AAGCACAGCAAGATATGGTTTGG | 1 | 2 | 49 | SEQ ID NO. 4751 |
| (N20)NGG | 11 | 36615100 | + | GATATGGTTTGGAAGCAACATGG | 1 | 2 | 48 | SEQ ID NO. 4752 |
| (N20)NGG | 11 | 36615101 | + | ATATGGTTTGGAAGCAACATGGG | 1 | 3 | 96 | SEQ ID NO. 4753 |
| (N20)NGG | 11 | 36615107 | + | TTTGGAAGCAACATGGGAAATGG | 1 | 8 | 210 | SEQ ID NO. 4754 |
| (N20)NGG | 11 | 36615122 | + | GGAAATGGAACTGTTTTTCTTGG | 1 | 14 | 119 | SEQ ID NO. 4755 |
| (N20)NGG | 11 | 36615131 | + | ACTGTTTTTCTTGGCATACCAGG | 1 | 2 | 51 | SEQ ID NO. 4756 |
| (N20)NGG | 11 | 36615158 | + | AATAAACAAGTTGTTTCAGAAGG | 2 | 6 | 109 | SEQ ID NO. 4757 |
| (N20)NGG | 11 | 36615251 | + | CAAACATCAACAGAAGATCCAGG | 1 | 4 | 57 | SEQ ID NO. 4758 |
| (N20)NGG | 11 | 36615252 | + | AAACATCAACAGAAGATCCAGGG | 1 | 8 | 97 | SEQ ID NO. 4759 |
| (N20)NGG | 11 | 36615253 | + | AACATCAACAGAAGATCCAGGGG | 1 | 4 | 72 | SEQ ID NO. 4760 |
| (N20)NGG | 11 | 36615317 | + | GCAGAAGCAAATAGTTTTGATGG | 1 | 3 | 92 | SEQ ID NO. 4761 |
| (N20)NGG | 11 | 36615374 | + | GAAGAAGATGAGTCTGAGACAGG | 1 | 7 | 125 | SEQ ID NO. 4762 |
| (N20)NGG | 11 | 36615381 | + | ATGAGTCTGAGACAGGCTACTGG | 1 | 2 | 29 | SEQ ID NO. 4763 |
| (N20)NGG | 11 | 36615409 | + | ATGCTGCCTACTTGTGATGTGG | 1 | 5 | 48 | SEQ ID NO. 4764 |
| (N20)NGG | 11 | 36615423 | + | GTGATGTGGATATCAACACTTGG | 1 | 5 | 19 | SEQ ID NO. 4765 |
| (N20)NGG | 11 | 36615424 | + | TGATGTGGATATCAACACTTGGG | 1 | 1 | 31 | SEQ ID NO. 4766 |
| (N20)NGG | 11 | 36615479 | + | GCCATGATCTACTGCTCTCATGG | 1 | 3 | 39 | SEQ ID NO. 4767 |
| (N20)NGG | 11 | 36615480 | + | CCATGATCTACTGCTCTCATGGG | 1 | 2 | 31 | SEQ ID NO. 4768 |

FIG. 14 cont.

| site_type | site_chr omosome | site_start nucleotide | site_s trand | target_site_sequence_wi th_NGG | genome_wide_ hits_with_1_ or_less_mism atches | genome_wide_ hits_with_2_ or_less_mism atches | genome_wide_ hits_with_3_ or_less_mism atches | |
|---|---|---|---|---|---|---|---|---|
| (N20)NGG | 11 | 36615481 | + | CATGATCTACTGCTCTCATGGGG | 1 | 3 | 22 | SEQ ID NO. 4769 |
| (N20)NGG | 11 | 36615485 | + | ATCTACTGCTCTCATGGGGATGG | 1 | 2 | 37 | SEQ ID NO. 4770 |
| (N20)NGG | 11 | 36615486 | + | TCTACTGCTCTCATGGGGATGGG | 1 | 3 | 34 | SEQ ID NO. 4771 |
| (N20)NGG | 11 | 36615492 | + | GCTCTCATGGGGATGGGCACTGG | 1 | 3 | 36 | SEQ ID NO. 4772 |
| (N20)NGG | 11 | 36615493 | + | CTCTCATGGGGATGGGCACTGGG | 2 | 3 | 45 | SEQ ID NO. 4773 |
| (N20)NGG | 11 | 36615511 | + | CTGGGTCCATGCTCAGTGCATGG | 1 | 4 | 50 | SEQ ID NO. 4774 |
| (N20)NGG | 11 | 36615517 | + | CCATGCTCAGTGCATGGATCTGG | 1 | 3 | 34 | SEQ ID NO. 4775 |
| (N20)NGG | 11 | 36615548 | + | ACACTCATCCATCTGTCAGCAGG | 1 | 7 | 46 | SEQ ID NO. 4776 |
| (N20)NGG | 11 | 36615580 | + | GTATTACTGCAATGAGCATGTGG | 1 | 4 | 77 | SEQ ID NO. 4777 |
| (N20)NGG | 11 | 36615659 | + | ATGAAATCCCTCCGTAAAAAAGG | 1 | 3 | 25 | SEQ ID NO. 4778 |
| (N20)NGG | 11 | 36615665 | + | TCCCTCCGTAAAAAAGGTTCTGG | 1 | 1 | 10 | SEQ ID NO. 4779 |
| (N20)NGG | 11 | 36615705 | + | CCAAGAAATCCTTTCTTAGAAGG | 1 | 5 | 71 | SEQ ID NO. 4780 |
| (N20)NGG | 11 | 36614171 | - | TGAGAAGCCTGGCTGAAGAAGG | 1 | 5 | 54 | SEQ ID NO. 4781 |
| (N20)NGG | 11 | 36614182 | - | AAATTCATCAGTGAGAAGCCTGG | 2 | 3 | 61 | SEQ ID NO. 4782 |
| (N20)NGG | 11 | 36614242 | - | CCAGTGGGCAGGATCTTTTTGG | 1 | 3 | 50 | SEQ ID NO. 4783 |
| (N20)NGG | 11 | 36614243 | - | TCCAGTGGGCAGGATCTTTTTGG | 1 | 1 | 27 | SEQ ID NO. 4784 |
| (N20)NGG | 11 | 36614252 | - | ATGGAAAACTCCAGTGGGCAGG | 1 | 6 | 47 | SEQ ID NO. 4785 |
| (N20)NGG | 11 | 36614256 | - | CCAGATGGAAAACTCCAGTGGGG | 1 | 3 | 58 | SEQ ID NO. 4786 |
| (N20)NGG | 11 | 36614257 | - | TCCAGATGGAAAACTCCAGTGGG | 1 | 3 | 70 | SEQ ID NO. 4787 |
| (N20)NGG | 11 | 36614258 | - | ATCCAGATGGAAAACTCCAGTGG | 1 | 7 | 85 | SEQ ID NO. 4788 |
| (N20)NGG | 11 | 36614271 | - | GGTTATGCTTTACATCCAGATGG | 1 | 2 | 21 | SEQ ID NO. 4789 |
| (N20)NGG | 11 | 36614292 | - | TTGTAGGCTTCAGTTTGACATGG | 1 | 3 | 44 | SEQ ID NO. 4790 |
| (N20)NGG | 11 | 36614308 | - | GAATCCTTAGAGAAAATTGTAGG | 1 | 6 | 86 | SEQ ID NO. 4791 |
| (N20)NGG | 11 | 36614330 | - | GCGAAGAGGAGGGAGGTAGCAGG | 1 | 9 | 101 | SEQ ID NO. 4792 |
| (N20)NGG | 11 | 36614337 | - | CTGGGTAGCGAAGAGGAGGGAGG | 1 | 6 | 94 | SEQ ID NO. 4793 |
| (N20)NGG | 11 | 36614340 | - | TGGCTGGGTAGCGAAGAGGAGGG | 1 | 3 | 67 | SEQ ID NO. 4794 |
| (N20)NGG | 11 | 36614341 | - | GTGGCTGGGTAGCGAAGAGGAGG | 1 | 4 | 55 | SEQ ID NO. 4795 |
| (N20)NGG | 11 | 36614344 | - | CAAGTGGCTGGGTAGCGAAGAGG | 1 | 3 | 21 | SEQ ID NO. 4796 |
| (N20)NGG | 11 | 36614355 | - | CTTTGAATGTGCAAGTGGCTGGG | 1 | 4 | 37 | SEQ ID NO. 4797 |
| (N20)NGG | 11 | 36614356 | - | CCTTTGAATGTGCAAGTGGCTGG | 1 | 2 | 29 | SEQ ID NO. 4798 |
| (N20)NGG | 11 | 36614360 | - | GCTGCCTTTGAATGTGCAAGTGG | 1 | 7 | 72 | SEQ ID NO. 4799 |
| (N20)NGG | 11 | 36614412 | - | TGTTTGGTGTTTCCCTCCATGG | 1 | 5 | 88 | SEQ ID NO. 4800 |
| (N20)NGG | 11 | 36614428 | - | TTATCTGAAACCTCATTGTTTGG | 1 | 7 | 60 | SEQ ID NO. 4801 |

FIG. 14 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20) NGG | 11 | 36614533 | - | GAATGACCATATCTGGCTTCAGG | 2 | 3 | 36 | SEQ ID NO. | 4802 |
| (N20) NGG | 11 | 36614540 | - | ATTAATGGAATGACCATATCTGG | 1 | 2 | 35 | SEQ ID NO. | 4803 |
| (N20) NGG | 11 | 36614555 | - | TCGGCTGTACACCACATTAATGG | 1 | 2 | 5 | SEQ ID NO. | 4804 |
| (N20) NGG | 11 | 36614574 | - | GAACACCCATACTTTTCCCTCGG | 1 | 2 | 29 | SEQ ID NO. | 4805 |
| (N20) NGG | 11 | 36614620 | - | TCTGTGGTTCTGTGGGTAGAAGG | 1 | 5 | 78 | SEQ ID NO. | 4806 |
| (N20) NGG | 11 | 36614627 | - | CCATTTTCTGTGGTTCTGTGGG | 1 | 6 | 144 | SEQ ID NO. | 4807 |
| (N20) NGG | 11 | 36614628 | - | TCCATTTTCTGTGGTTCTGTGG | 1 | 9 | 120 | SEQ ID NO. | 4808 |
| (N20) NGG | 11 | 36614636 | - | TACACTATTCCATTTTCTGTGG | 1 | 8 | 105 | SEQ ID NO. | 4809 |
| (N20) NGG | 11 | 36614667 | - | CCACCAGGAAAACACAGGGCAGG | 1 | 7 | 95 | SEQ ID NO. | 4810 |
| (N20) NGG | 11 | 36614671 | - | AAATCCACCAGGAAAACACAGG | 1 | 12 | 140 | SEQ ID NO. | 4811 |
| (N20) NGG | 11 | 36614672 | - | AAAATCCACCAGGAAAACACAGG | 1 | 8 | 96 | SEQ ID NO. | 4812 |
| (N20) NGG | 11 | 36614682 | - | ACCCAAATTCAAAATCCACCAGG | 1 | 6 | 79 | SEQ ID NO. | 4813 |
| (N20) NGG | 11 | 36614725 | - | GATAGCCCATCCTGAAGTTCTGG | 1 | 1 | 16 | SEQ ID NO. | 4814 |
| (N20) NGG | 11 | 36614765 | - | AATATAGATGGTGTCATTTTTGG | 2 | 3 | 110 | SEQ ID NO. | 4815 |
| (N20) NGG | 11 | 36614777 | - | ATGTCCCTCCTAAAATATAGATGG | 1 | 8 | 100 | SEQ ID NO. | 4816 |
| (N20) NGG | 11 | 36614807 | - | GTTGGCAGGCCGGATATTATTGG | 1 | 1 | 7 | SEQ ID NO. | 4817 |
| (N20) NGG | 11 | 36614817 | - | TTCTGTACAGGTTGGCAGGCCGG | 1 | 8 | 194 | SEQ ID NO. | 4818 |
| (N20) NGG | 11 | 36614821 | - | CTTATTCTGTACAGGTTGGCAGG | 1 | 1 | 23 | SEQ ID NO. | 4819 |
| (N20) NGG | 11 | 36614825 | - | AACCCTTATTCTGTACAGGTTGG | 1 | 2 | 21 | SEQ ID NO. | 4820 |
| (N20) NGG | 11 | 36614829 | - | GATCAAACCCTTATTCTGTACAGG | 2 | 1 | 11 | SEQ ID NO. | 4821 |
| (N20) NGG | 11 | 36614854 | - | TTCACAGCTGGGCTACCAGGGG | 1 | 4 | 54 | SEQ ID NO. | 4822 |
| (N20) NGG | 11 | 36614855 | - | ATTCACAGCTGGGCTACCCAGG | 1 | 1 | 32 | SEQ ID NO. | 4823 |
| (N20) NGG | 11 | 36614856 | - | AATTCACAGCTGGGCTACCCAGG | 1 | 2 | 25 | SEQ ID NO. | 4824 |
| (N20) NGG | 11 | 36614865 | - | AGACTGTGCAATTCACAGCTGGG | 1 | 1 | 42 | SEQ ID NO. | 4825 |
| (N20) NGG | 11 | 36614866 | - | AAGACTGTGCAATTCACAGCTGG | 1 | 2 | 43 | SEQ ID NO. | 4826 |
| (N20) NGG | 11 | 36614890 | - | CTGGAGACAGAGATTCCTCCTGG | 1 | 4 | 80 | SEQ ID NO. | 4827 |
| (N20) NGG | 11 | 36614909 | - | AGTTTGAGTCAGGATTGCACTGG | 1 | 4 | 23 | SEQ ID NO. | 4828 |
| (N20) NGG | 11 | 36614919 | - | CATCATTGTTAGTTTGAGTCAGG | 1 | 1 | 31 | SEQ ID NO. | 4829 |
| (N20) NGG | 11 | 36615044 | - | AATGTCTGGGGTCCAATCTGGG | 1 | 5 | 30 | SEQ ID NO. | 4830 |
| (N20) NGG | 11 | 36615045 | - | TAATGTCTGGGGTCCAATCTGG | 1 | 3 | 22 | SEQ ID NO. | 4831 |
| (N20) NGG | 11 | 36615046 | - | TTAATGTCTGGGGTCCAATCTG | 1 | 2 | 21 | SEQ ID NO. | 4832 |
| (N20) NGG | 11 | 36615056 | - | CTTGCTGTGCTTAATGTCTGGGG | 1 | 5 | 54 | SEQ ID NO. | 4833 |
| (N20) NGG | 11 | 36615057 | - | TCTTGCTGTGCTTAATGTCTGGG | 1 | 2 | 70 | SEQ ID NO. | 4834 |

FIG. 14 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 11 | 36615058 | - | ATCTTGCTGTGCTTAATGTCTGG | 1 | 1 | 36 | SEQ ID NO. 4835 |
| (N20)NGG | 11 | 36615127 | - | ACAACTTGTTTATTGTCTCCTGG | 1 | 5 | 70 | SEQ ID NO. 4836 |
| (N20)NGG | 11 | 36615247 | - | TCAAAGGAGTGGAATCCCCTGG | 1 | 3 | 23 | SEQ ID NO. 4837 |
| (N20)NGG | 11 | 36615257 | - | TTCAGAGTCTTCAAAGGAGTGG | 1 | 6 | 79 | SEQ ID NO. 4838 |
| (N20)NGG | 11 | 36615262 | - | AATTCTTCAGAGTCTTCAAAGG | 1 | 13 | 151 | SEQ ID NO. 4839 |
| (N20)NGG | 11 | 36615263 | - | AAATTCTTCAGAGTCTTCAAAGG | 1 | 7 | 122 | SEQ ID NO. 4840 |
| (N20)NGG | 11 | 36615335 | - | TTCTTCATCATCTTCATTATAGG | 2 | 21 | 338 | SEQ ID NO. 4841 |
| (N20)NGG | 11 | 36615393 | - | TGATATCCACATCACAAGTAGGG | 1 | 2 | 30 | SEQ ID NO. 4842 |
| (N20)NGG | 11 | 36615394 | - | TTGAGCTCAGTTGAATAGAATGG | 1 | 5 | 26 | SEQ ID NO. 4843 |
| (N20)NGG | 11 | 36615427 | - | TTGAGCTCAGTTGAATAGAATGG | 1 | 3 | 42 | SEQ ID NO. 4844 |
| (N20)NGG | 11 | 36615454 | - | TGAGAGCAGTAGATCATGGCGG | 1 | 3 | 43 | SEQ ID NO. 4845 |
| (N20)NGG | 11 | 36615455 | - | ATGAGACAGTAGATCATGGCGG | 1 | 4 | 44 | SEQ ID NO. 4846 |
| (N20)NGG | 11 | 36615458 | - | CCCATGAGACCAGTAGATCATGG | 1 | 3 | 29 | SEQ ID NO. 4847 |
| (N20)NGG | 11 | 36615495 | - | CCAGATCCATGCCACTGAGCATGG | 1 | 1 | 44 | SEQ ID NO. 4848 |
| (N20)NGG | 11 | 36615534 | - | TGTTGCTTCCTGCTGACAGATGG | 1 | 3 | 89 | SEQ ID NO. 4849 |
| (N20)NGG | 11 | 36615604 | - | TTTAAGGGTAGGACTCTTTGGGG | 1 | 2 | 36 | SEQ ID NO. 4850 |
| (N20)NGG | 11 | 36615605 | - | TTTAAGGGTAGGACTCTTTTGG | 1 | 8 | 46 | SEQ ID NO. 4851 |
| (N20)NGG | 11 | 36615606 | - | TTTTTAAGGGTAGGACTCTTTGG | 1 | 2 | 54 | SEQ ID NO. 4852 |
| (N20)NGG | 11 | 36615615 | - | TTGGAGGCTTTTTAAGGGTAGG | 1 | 5 | 52 | SEQ ID NO. 4853 |
| (N20)NGG | 11 | 36615619 | - | TTCATTGGAGCTTTTTAAGGG | 2 | 9 | 98 | SEQ ID NO. 4854 |
| (N20)NGG | 11 | 36615620 | - | TTTCATTGGAGCTTTTTAAGG | 2 | 11 | 101 | SEQ ID NO. 4855 |
| (N20)NGG | 11 | 36615631 | - | TTACGGAGGATTTCATTGGAGG | 1 | 2 | 11 | SEQ ID NO. 4856 |
| (N20)NGG | 11 | 36615634 | - | TTTTTACGGAGGGATTTCATTGG | 1 | 3 | 24 | SEQ ID NO. 4857 |
| (N20)NGG | 11 | 36615644 | - | TCCAGAACCTTTTTACGGAGGG | 1 | 1 | 20 | SEQ ID NO. 4858 |
| (N20)NGG | 11 | 36615645 | - | TTCCAGAACCTTTTTACGGAGG | 1 | 2 | 19 | SEQ ID NO. 4859 |
| (N20)NGG | 11 | 36615648 | - | TTTTTCCAGAACCTTTTTACGG | 1 | 12 | 219 | SEQ ID NO. 4860 |
| (N20)NGG | 11 | 36615679 | - | CTAAGAAAGATTTCTTGGCAGG | 2 | 4 | 86 | SEQ ID NO. 4861 |
| (N20)NGG | 11 | 36615683 | - | CCTTCTAAGAAAGGATTTCTTGG | 1 | 8 | 100 | SEQ ID NO. 4862 |
| (N20)NGG | 11 | 36615692 | - | ATCAAACAACCTTCTAAGAAAGG | 1 | 5 | 63 | SEQ ID NO. 4863 |

FIG. 14 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 2 | 98340496 | + | GCAGGTTTCGGAGGCCCAGGGG | 1 | | 3 | 38 SEQ ID NO. 4864 |
| (N20)NGG | 2 | 98340514 | + | AGGGGCGATGCCAGACCCGCGG | 1 | | 1 | 18 SEQ ID NO. 4865 |
| (N20)NGG | 2 | 98340536 | + | GCGCACCTGCCCTTCTTCTACG | 1 | | 1 | 16 SEQ ID NO. 4866 |
| (N20)NGG | 2 | 98340556 | + | CGGCAGCATCTCGCGTGCCGAGG | 1 | | 1 | 5 SEQ ID NO. 4867 |
| (N20)NGG | 2 | 98340562 | + | CATCTCGCGTGCCGAGGCGAGG | 1 | | 1 | 3 SEQ ID NO. 4868 |
| (N20)NGG | 2 | 98340577 | + | GGCCGAGGAGCACCTGAAGCTGG | 1 | | 5 | 72 SEQ ID NO. 4869 |
| (N20)NGG | 2 | 98340580 | + | CGAGGAGCACCTGAAGCTGGCGG | 1 | | 17 | 373 SEQ ID NO. 4870 |
| (N20)NGG | 2 | 98340581 | + | GAGGAGCACCTGAAGCTGGCGG | 1 | | 11 | 352 SEQ ID NO. 4871 |
| (N20)NGG | 2 | 98340586 | + | GCACCTGAAGCTGGCGGGCATGG | 1 | | 3 | 69 SEQ ID NO. 4872 |
| (N20)NGG | 2 | 98340589 | + | CCTGAAGCTGGCGGGCATGGCGG | 1 | | 2 | 52 SEQ ID NO. 4873 |
| (N20)NGG | 2 | 98340593 | + | AAGCTGGCGGGCATGGCGACGG | 1 | | 2 | 20 SEQ ID NO. 4874 |
| (N20)NGG | 2 | 98340594 | + | AGCTGGCGGGCATGGCGACGG | 1 | | 2 | 18 SEQ ID NO. 4875 |
| (N20)NGG | 2 | 98340628 | + | GCGCCAGTGCCTCGCGCTCGCTGG | 1 | | 2 | 13 SEQ ID NO. 4876 |
| (N20)NGG | 2 | 98340629 | + | CGCCAGTGCCTCGCGCTCGCTGGG | 1 | | 2 | 17 SEQ ID NO. 4877 |
| (N20)NGG | 2 | 98340632 | + | CAGTGCCTCGCGCTCGCTGGGCGG | 1 | | 1 | 19 SEQ ID NO. 4878 |
| (N20)NGG | 2 | 98340698 | + | CCCATCGAGGCCAGCTCAACGG | 1 | | 3 | 14 SEQ ID NO. 4879 |
| (N20)NGG | 2 | 98340716 | + | AACGGCACCTACGCCATTGCCGG | 1 | | 2 | 4 SEQ ID NO. 4880 |
| (N20)NGG | 2 | 98340719 | + | GGCACCTACGCCATTGCCGGCGG | 2 | | 2 | 10 SEQ ID NO. 4881 |
| (N20)NGG | 2 | 98340734 | + | GCCGGCGGCAAAGCGCACTGTGG | 1 | | 2 | 10 SEQ ID NO. 4882 |
| (N20)NGG | 2 | 98340739 | + | CGGCAAAGCGCACTGTGGACCGG | 1 | | 1 | 7 SEQ ID NO. 4883 |
| (N20)NGG | 2 | 98340776 | + | TTCTACTCGCGCGACCCCGACGG | 1 | | 1 | 1 SEQ ID NO. 4884 |
| (N20)NGG | 2 | 98340777 | + | TCTACTCGCGCGACCCCGACGGG | 1 | | 1 | 1 SEQ ID NO. 4885 |
| (N20)NGG | 2 | 98340810 | + | ACCTGCGCAAGCCGTGCAACCGG | 1 | | 1 | 9 SEQ ID NO. 4886 |
| (N20)NGG | 2 | 98340817 | + | CAAGCCGTGCAACCGGCCGTCGG | 1 | | 1 | 3 SEQ ID NO. 4887 |
| (N20)NGG | 2 | 98340818 | + | AAGCCGTGCAACCGGCCGTCGGG | 1 | | 1 | 1 SEQ ID NO. 4888 |
| (N20)NGG | 2 | 98340835 | + | GTCGGGCCTCGAGCCCAGCCGG | 1 | | 21 | 58 SEQ ID NO. 4889 |
| (N20)NGG | 2 | 98340836 | + | TCGGGCCTCGAGCCCAGCCGGG | 1 | | 20 | 58 SEQ ID NO. 4890 |
| (N20)NGG | 2 | 98340837 | + | CGGGCCTCGAGCCCAGCCGGGG | 1 | | 2 | 49 SEQ ID NO. 4891 |
| (N20)NGG | 2 | 98340838 | + | GGGCCTCGAGCCCAGCCGGGGG | 1 | | 22 | 81 SEQ ID NO. 4892 |
| (N20)NGG | 2 | 98340865 | + | CGACTGCCTGCCGAGACGCCATGG | 1 | | 1 | 8 SEQ ID NO. 4893 |
| (N20)NGG | 2 | 98340891 | + | GTGACTACGTGCCCAGACGTGG | 1 | | 1 | 3 SEQ ID NO. 4894 |
| (N20)NGG | 2 | 98340898 | + | CGTGCGCCAGACGTGGAAGCTGG | 1 | | 1 | 6 SEQ ID NO. 4895 |
| (N20)NGG | 2 | 98340901 | + | GCGCCAGACGTGGAAGCTGGAGG | 1 | | 1 | 18 SEQ ID NO. 4896 |

FIG. 15

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 2 | 98340917 | + | CTGAGGTGAGAGCCAGCCTGG | 1 | 2 | 78 | SEQ ID NO. 4897 |
| (N20)NGG | 2 | 98340918 | + | TGGAGGTGAGAGCCAGCCTGGG | 1 | 6 | 72 | SEQ ID NO. 4898 |
| (N20)NGG | 2 | 98340919 | + | GGAGGTGAGAGCCAGCCTGGGG | 1 | 6 | 109 | SEQ ID NO. 4899 |
| (N20)NGG | 2 | 98340924 | + | TGAGAGCGCAGCCTGGGGCGCGG | 1 | 1 | 51 | SEQ ID NO. 4900 |
| (N20)NGG | 2 | 98340925 | + | GAGAGCGCAGCCTGGGGCGCGG | 1 | 5 | 53 | SEQ ID NO. 4901 |
| (N20)NGG | 2 | 98340489 | - | CGGGTCTGGCATCGCCCCTGG | 1 | 3 | 22 | SEQ ID NO. 4902 |
| (N20)NGG | 2 | 98340490 | - | GCGGGTCTGGCATCGCCCCTG | 1 | 1 | 13 | SEQ ID NO. 4903 |
| (N20)NGG | 2 | 98340502 | - | GGCAGTGCGCCGCGGGGTCTGG | 1 | 2 | 34 | SEQ ID NO. 4904 |
| (N20)NGG | 2 | 98340507 | - | AGAAGGGCAGGTGCCGCCGGG | 1 | 1 | 23 | SEQ ID NO. 4905 |
| (N20)NGG | 2 | 98340508 | - | AAGAAGGGCAGGTGCCGCCGGG | 1 | 3 | 19 | SEQ ID NO. 4906 |
| (N20)NGG | 2 | 98340509 | - | GAAGAAGGGCAGGTGCGCCGG | 1 | 5 | 35 | SEQ ID NO. 4907 |
| (N20)NGG | 2 | 98340519 | - | TGCTGCCGTAGAAGAGGGCAGG | 1 | 1 | 24 | SEQ ID NO. 4908 |
| (N20)NGG | 2 | 98340523 | - | GAGATGCTGCCGTAGAAGAAGG | 1 | 3 | 41 | SEQ ID NO. 4909 |
| (N20)NGG | 2 | 98340524 | - | CGAGATGCTGCCGTAGAAGAAG | 1 | 1 | 10 | SEQ ID NO. 4910 |
| (N20)NGG | 2 | 98340551 | - | CTTCAGGTGCTCTCCGGCCTCG | 1 | 1 | 94 | SEQ ID NO. 4911 |
| (N20)NGG | 2 | 98340557 | - | CGCCAGCTTCAGGTGCTCCTCG | 1 | 5 | 47 | SEQ ID NO. 4912 |
| (N20)NGG | 2 | 98340567 | - | CCGCCATGCCCGCCAGCTTCAGG | 1 | 3 | 34 | SEQ ID NO. 4913 |
| (N20)NGG | 2 | 98340600 | - | AGCGCAGGCACTGCCGCCAGCAGG | 1 | 2 | 21 | SEQ ID NO. 4914 |
| (N20)NGG | 2 | 98340609 | - | CGCCCAGCGAGCGCAGGCACTGG | 1 | 1 | 18 | SEQ ID NO. 4915 |
| (N20)NGG | 2 | 98340615 | - | CATAGCCGCCCAGCGAGCGCAGG | 1 | 1 | 7 | SEQ ID NO. 4916 |
| (N20)NGG | 2 | 98340666 | - | GGCGCTCGATGGGAAAGTGGTGG | 1 | 2 | 17 | SEQ ID NO. 4917 |
| (N20)NGG | 2 | 98340669 | - | GCTGGCGCTCGATGGGAAAGTGG | 1 | 2 | 8 | SEQ ID NO. 4918 |
| (N20)NGG | 2 | 98340676 | - | CCGTTGAGCTGGCGCTCGATGG | 1 | 1 | 3 | SEQ ID NO. 4919 |
| (N20)NGG | 2 | 98340677 | - | GCCGTTGAGCTGGCCGTTGAGCTGG | 1 | 1 | 9 | SEQ ID NO. 4920 |
| (N20)NGG | 2 | 98340687 | - | TGGCGTAGGTGCCGTTGAGCTGG | 1 | 1 | 11 | SEQ ID NO. 4921 |
| (N20)NGG | 2 | 98340701 | - | TTTGCCGCCGGCAATGGCGTAGG | 1 | 1 | 2 | SEQ ID NO. 4922 |
| (N20)NGG | 2 | 98340707 | - | GTGCGCTTTGCCGCCGGCAATGG | 1 | 1 | 1 | SEQ ID NO. 4923 |
| (N20)NGG | 2 | 98340713 | - | TCCACAGTGCGCTTTGCCGCCGG | 1 | 2 | 15 | SEQ ID NO. 4924 |
| (N20)NGG | 2 | 98340736 | - | TAGAACTCGCAGAGCTCTGCCGG | 1 | 2 | 17 | SEQ ID NO. 4925 |
| (N20)NGG | 2 | 98340768 | - | GGTTGCAGGGCAGCCCCTCGGGG | 1 | 2 | 14 | SEQ ID NO. 4926 |
| (N20)NGG | 2 | 98340769 | - | AGGTTGCAGGGCAGCCCGTCGG | 1 | 1 | 20 | SEQ ID NO. 4927 |
| (N20)NGG | 2 | 98340770 | - | CAGGTTGCAGGGCAGCCCGTCGG | 1 | 4 | 23 | SEQ ID NO. 4928 |
| (N20)NGG | 2 | 98340781 | - | CACGGCTTGCGCAGGTTGCAGGG | 1 | 1 | 10 | SEQ ID NO. 4929 |

FIG. 15 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 2 | 98340782 | - | GCACGGCTTGCGCAGGTTGCAGG | 1 | 1 | 8 | SEQ ID NO. 4930 |
| (N20)NGG | 2 | 98340789 | - | GCCGGTTGCACGGCTTGCGCAGG | 1 | 1 | 5 | SEQ ID NO. 4931 |
| (N20)NGG | 2 | 98340799 | - | AGGCCCGACACGCCGGTTGCACGG | 1 | 1 | 4 | SEQ ID NO. 4932 |
| (N20)NGG | 2 | 98340807 | - | GCGGCTCGAGGCCCGACGGCCGG | 1 | 1 | 12 | SEQ ID NO. 4933 |
| (N20)NGG | 2 | 98340811 | - | GGGCTGCGGCTCGAGGCCCGACGG | 1 | 2 | 28 | SEQ ID NO. 4934 |
| (N20)NGG | 2 | 98340819 | - | AGACCCCGGCTGCGGCTCGAGG | 1 | 3 | 13 | SEQ ID NO. 4935 |
| (N20)NGG | 2 | 98340826 | - | CAGTGCAAGACCCCGGCTGCGG | 1 | 2 | 7 | SEQ ID NO. 4936 |
| (N20)NGG | 2 | 98340832 | - | CGCAGGCAGTGCAAGACCCCGG | 1 | 1 | 12 | SEQ ID NO. 4937 |
| (N20)NGG | 2 | 98340849 | - | CACGCACCATGGCGTCTGCAGG | 1 | 1 | 9 | SEQ ID NO. 4938 |
| (N20)NGG | 2 | 98340860 | - | GCGCACGTAGTCACGCACCATGG | 1 | 1 | 4 | SEQ ID NO. 4939 |
| (N20)NGG | 2 | 98340882 | - | TCACCTCCAGTTCCACGTCTGG | 2 | 3 | 41 | SEQ ID NO. 4940 |
| (N20)NGG | 2 | 98341554 | + | CTCCTCGCCTCTCCTTTTCTAGG | 1 | 7 | 162 | SEQ ID NO. 4941 |
| (N20)NGG | 2 | 98341555 | + | TCCTCGCCTCTCCTTTTCTAGGG | 1 | 2 | 71 | SEQ ID NO. 4942 |
| (N20)NGG | 2 | 98341560 | + | GCCTCTCCTTTTCTAGGGCGAGG | 1 | 1 | 33 | SEQ ID NO. 4943 |
| (N20)NGG | 2 | 98341566 | + | CCTTTTCTAGGGCGAGGCCCTGG | 1 | 4 | 21 | SEQ ID NO. 4944 |
| (N20)NGG | 2 | 98341572 | + | CTAGGGCGAGGCCCTGAGCAGG | 1 | 2 | 38 | SEQ ID NO. 4945 |
| (N20)NGG | 2 | 98341587 | + | GGAGCAGGCCATCATCAGCCAGG | 1 | 5 | 39 | SEQ ID NO. 4946 |
| (N20)NGG | 2 | 98341596 | + | CATCATCAGCCAGGCCCCGCAGG | 1 | 2 | 32 | SEQ ID NO. 4947 |
| (N20)NGG | 2 | 98341599 | + | CATCAGCCAGGCCCCGCAGGTGG | 2 | 6 | 80 | SEQ ID NO. 4948 |
| (N20)NGG | 2 | 98341620 | + | GGAGAAGCTCATTGCTACGACGG | 1 | 2 | 19 | SEQ ID NO. 4949 |
| (N20)NGG | 2 | 98341631 | + | TTGCTACGACGGCCCACGAGCGG | 1 | 1 | 1 | SEQ ID NO. 4950 |
| (N20)NGG | 2 | 98341640 | + | CGGCCCACGAGCGGATGCCCTGG | 1 | 1 | 4 | SEQ ID NO. 4951 |
| (N20)NGG | 2 | 98341665 | + | CCACAGCAGCCTGACGCGTGAGG | 1 | 2 | 24 | SEQ ID NO. 4952 |
| (N20)NGG | 2 | 98341668 | + | CAGCAGCCTGACGCGTGAGGAGG | 2 | 3 | 18 | SEQ ID NO. 4953 |
| (N20)NGG | 2 | 98341690 | + | GCCGAGCGCAAACTTTACTCTGG | 1 | 1 | 3 | SEQ ID NO. 4954 |
| (N20)NGG | 2 | 98341691 | + | CCGAGCGCAAACTTTACTCTGGG | 1 | 1 | 2 | SEQ ID NO. 4955 |
| (N20)NGG | 2 | 98341692 | + | CGAGCGCAAACTTTACTCTGGGG | 1 | 1 | 5 | SEQ ID NO. 4956 |
| (N20)NGG | 2 | 98341705 | + | TACTCTGGGGCGCAGACCGACGG | 1 | 1 | 6 | SEQ ID NO. 4957 |
| (N20)NGG | 2 | 98341722 | + | CGACGGCAAGTTCCTGTATGTGG | 1 | 4 | 7 | SEQ ID NO. 4958 |
| (N20)NGG | 2 | 98341723 | + | GACGGCAAGTTCCTGTATGTGGG | 1 | 1 | 9 | SEQ ID NO. 4959 |
| (N20)NGG | 2 | 98341724 | + | ACGGCAAGTTCCTGTATGTGGGG | 1 | 3 | 16 | SEQ ID NO. 4960 |
| (N20)NGG | 2 | 98341729 | + | AAGTTCCTGTATGTGGGGCCCGG | 1 | 2 | 26 | SEQ ID NO. 4961 |
| (N20)NGG | 2 | 98341730 | + | AGTTCCTGTATGTGGGGCCCGGG | 1 | 4 | 45 | SEQ ID NO. 4962 |

FIG. 15 cont.

| site type | site chromosome | site start nucleotide | site strand | target site sequence with NGG | genome wide hits with 1 or less mismatches | genome wide hits with 2 or less mismatches | genome wide hits with 3 or less mismatches | SEQ ID NO. |
|---|---|---|---|---|---|---|---|---|
| (N20)NGG | 2 | 98341736 | + | TGTATGTGGGCCCGGGATTTGG |  |  | 2 | 26 SEQ ID NO. 4963 |
| (N20)NGG | 2 | 98341737 | + | GTATGTGGGCCCGGGATTTGGG | 1 |  | 2 | 21 SEQ ID NO. 4964 |
| (N20)NGG | 2 | 98341531 | - | CTAGAAAAGGAGAGGCGAGAGG | 1 |  | 6 | 100 SEQ ID NO. 4965 |
| (N20)NGG | 2 | 98341534 | - | GCCCTAGAAAAGGAGAGGCGAGG | 1 |  | 1 | 30 SEQ ID NO. 4966 |
| (N20)NGG | 2 | 98341539 | - | GCCTCGCCTAGAAAAGGAGAGG | 1 |  | 2 | 23 SEQ ID NO. 4967 |
| (N20)NGG | 2 | 98341544 | - | CCAGGGCCTCGCCTAGAAAAGG | 1 |  | 3 | 30 SEQ ID NO. 4968 |
| (N20)NGG | 2 | 98341561 | - | GCTGATGATGGCCTGCTCCAGG | 3 |  | 6 | 53 SEQ ID NO. 4969 |
| (N20)NGG | 2 | 98341562 | - | GGCTGATGATGGCCTGCTCCAG | 1 |  | 7 | 52 SEQ ID NO. 4970 |
| (N20)NGG | 2 | 98341573 | - | CTGCGGGCCTGGCTGATGATGG | 1 |  | 1 | 41 SEQ ID NO. 4971 |
| (N20)NGG | 2 | 98341583 | - | GCTTCTCCACCTGCGGGGCCTGG | 1 |  | 7 | 75 SEQ ID NO. 4972 |
| (N20)NGG | 2 | 98341588 | - | AATGAGCTTCTCCACCTGCGGG | 1 |  | 2 | 33 SEQ ID NO. 4973 |
| (N20)NGG | 2 | 98341589 | - | CAATGAGCTTCTCTCCACCTGCGG | 2 |  | 11 | 57 SEQ ID NO. 4974 |
| (N20)NGG | 2 | 98341590 | - | GCAATGAGCTTCTCTCCACCTGCG | 2 |  | 6 | 33 SEQ ID NO. 4975 |
| (N20)NGG | 2 | 98341621 | - | GTACCAGGGCATCCGCTCGTGG | 1 |  | 1 | 5 SEQ ID NO. 4976 |
| (N20)NGG | 2 | 98341622 | - | GGTACCAGGGCATCCGCTCGTG | 1 |  | 1 | 9 SEQ ID NO. 4977 |
| (N20)NGG | 2 | 98341635 | - | GTCAGGCTGCTGTGGTACCAGG | 1 |  | 2 | 53 SEQ ID NO. 4978 |
| (N20)NGG | 2 | 98341636 | - | CGTCAGGCTGCTGTGGTACCAG | 1 |  | 2 | 49 SEQ ID NO. 4979 |
| (N20)NGG | 2 | 98341643 | - | CCTCACGCGTCAGGCTGCTGTG | 1 |  | 2 | 25 SEQ ID NO. 4980 |
| (N20)NGG | 2 | 98341652 | - | GCTCGGCCTCCTCACGCGTCAG | 1 |  | 4 | 9 SEQ ID NO. 4981 |
| (N20)NGG | 2 | 98341669 | - | CCCAGAGTAAAGTTTGCGCTCGG | 1 |  | 1 | 6 SEQ ID NO. 4982 |
| (N20)NGG | 2 | 98341699 | - | CACATACAGGAACTTGCCGTCG | 1 |  | 2 | 19 SEQ ID NO. 4983 |
| (N20)NGG | 2 | 98341712 | - | AAATCCGGGCCCCACATACAGG | 1 |  | 2 | 12 SEQ ID NO. 4984 |
| (N20)NGG | 2 | 98349345 | + | ATCCCTCCCTTCCCTGCCAGG | 1 |  | 19 | 323 SEQ ID NO. 4985 |
| (N20)NGG | 2 | 98349351 | + | TCCCTTCCCCTGCCAGGCTGAGG | 4 |  | 40 | 380 SEQ ID NO. 4986 |
| (N20)NGG | 2 | 98349357 | + | CCCTGCCAGGCTGAGGCCGCGG | 1 |  | 8 | 116 SEQ ID NO. 4987 |
| (N20)NGG | 2 | 98349361 | + | TGCCAGGCTGAGGCCGCGGAAGG | 1 |  | 2 | 53 SEQ ID NO. 4988 |
| (N20)NGG | 2 | 98349367 | + | GCTGAGGCCGCGGAAGGAGCAGG | 1 |  | 4 | 92 SEQ ID NO. 4989 |
| (N20)NGG | 2 | 98349368 | + | CTGAGGCCGCGGAAGGAGCAGG | 1 |  | 4 | 72 SEQ ID NO. 4990 |
| (N20)NGG | 2 | 98349395 | + | TACGCCCTGTCCCTCATCTATGG | 1 |  | 4 | 10 SEQ ID NO. 4991 |
| (N20)NGG | 2 | 98349396 | + | ACGCCCTGTCCCTCATCTATGGG | 1 |  | 1 | 12 SEQ ID NO. 4992 |
| (N20)NGG | 2 | 98349403 | + | GTCCCTCATCTATGGGAAGACGG | 1 |  | 4 | 37 SEQ ID NO. 4993 |
| (N20)NGG | 2 | 98349433 | + | CTACCTCATCAGCCAAGACAAGG | 1 |  | 1 | 45 SEQ ID NO. 4994 |
| (N20)NGG | 2 | 98349436 | + | CCTCATCAGCCAAGACAAGGCCGG | 2 |  | 4 | 58 SEQ ID NO. 4995 |

FIG. 15 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 2 | 98349437 | + | CTCATCAGCCAAGACAAGGCGGG | 1 | 4 | 45 | SEQ ID NO. 4996 |
| (N20)NGG | 2 | 98349457 | + | GGGCAAGTACTGCATTCCCGAGG | 1 | 2 | 10 | SEQ ID NO. 4997 |
| (N20)NGG | 2 | 98349458 | + | GGCAAGTACTGCATTCCCGAGGG | 1 | 2 | 12 | SEQ ID NO. 4998 |
| (N20)NGG | 2 | 98349480 | + | GCACCAAGTTTGACACGCTCTGG | 1 | 1 | 6 | SEQ ID NO. 4999 |
| (N20)NGG | 2 | 98349484 | + | CAAGTTTGACACGCTCTGGCAGG | 1 | 2 | 14 | SEQ ID NO. 5000 |
| (N20)NGG | 2 | 98349488 | + | TTTGACACGCTCTGGCAGGTAGG | 1 | 1 | 18 | SEQ ID NO. 5001 |
| (N20)NGG | 2 | 98349325 | - | AGCCTGGCAGGGGAAGGGAGGGG | 2 | 25 | 373 | SEQ ID NO. 5002 |
| (N20)NGG | 2 | 98349326 | - | CAGCCTGGCAGGGGAAGGGAGGG | 3 | 31 | 429 | SEQ ID NO. 5003 |
| (N20)NGG | 2 | 98349327 | - | TCAGCCTGGCAGGGGAAGGGAGG | 3 | 26 | 293 | SEQ ID NO. 5004 |
| (N20)NGG | 2 | 98349330 | - | GCCTCAGCCTGGCAGGGGAAGGG | 1 | 17 | 236 | SEQ ID NO. 5005 |
| (N20)NGG | 2 | 98349331 | - | GGCCTCAGCCTGGCAGGGGAAGG | 1 | 20 | 289 | SEQ ID NO. 5006 |
| (N20)NGG | 2 | 98349335 | - | CCGGCGGCCTCAGCCTGGCAGGG | 1 | 8 | 55 | SEQ ID NO. 5007 |
| (N20)NGG | 2 | 98349336 | - | TCCGCGGCCTCAGCCTGGCAGGG | 1 | 6 | 108 | SEQ ID NO. 5008 |
| (N20)NGG | 2 | 98349337 | - | TTCCGCGGCCTCAGCCTGGCAGG | 1 | 2 | 211 | SEQ ID NO. 5009 |
| (N20)NGG | 2 | 98349341 | - | CTCCTTCCGCGGCCTCAGCCTGG | 2 | 3 | 38 | SEQ ID NO. 5010 |
| (N20)NGG | 2 | 98349352 | - | TATGTCCCTGCTCTCTTCCGCGG | 1 | 1 | 23 | SEQ ID NO. 5011 |
| (N20)NGG | 2 | 98349377 | - | CTTCCATAGATGAGGGACAGGG | 1 | 4 | 42 | SEQ ID NO. 5012 |
| (N20)NGG | 2 | 98349378 | - | TCTTCCATAGATGAGGGACAGG | 1 | 4 | 39 | SEQ ID NO. 5013 |
| (N20)NGG | 2 | 98349383 | - | CACCGTCTTCCCATAGATGAGGG | 1 | 2 | 15 | SEQ ID NO. 5014 |
| (N20)NGG | 2 | 98349384 | - | ACACCGTCTTCCCATAGATGAGG | 1 | 2 | 16 | SEQ ID NO. 5015 |
| (N20)NGG | 2 | 98349408 | - | TGTCTTGGCTGATGAGGTAGTGG | 1 | 1 | 46 | SEQ ID NO. 5016 |
| (N20)NGG | 2 | 98349414 | - | CCGGCTTGTCTTGGCTGATGAGG | 1 | 3 | 27 | SEQ ID NO. 5017 |
| (N20)NGG | 2 | 98349423 | - | AGTACTTGCCCGCCTGTCTTGG | 1 | 2 | 7 | SEQ ID NO. 5018 |
| (N20)NGG | 2 | 98349451 | - | GTGTCAAACTTGGTGCCCTCGG | 1 | 2 | 24 | SEQ ID NO. 5019 |
| (N20)NGG | 2 | 98349452 | - | CGTGTCAAACTTGGTGCCCTCG | 1 | 1 | 9 | SEQ ID NO. 5020 |
| (N20)NGG | 2 | 98349461 | - | CTGCCAGAGCGTGTCAAACTTGG | 1 | 1 | 11 | SEQ ID NO. 5021 |
| (N20)NGG | 2 | 98349590 | + | AGCTGCCTGCTCCCTGCAGCTGG | 3 | 18 | 173 | SEQ ID NO. 5022 |
| (N20)NGG | 2 | 98349593 | + | TGCCTGCTCCCTGCAGCTGGTGG | 2 | 17 | 246 | SEQ ID NO. 5023 |
| (N20)NGG | 2 | 98349611 | + | GGTGAAGTATCTGAAGCTGAAGG | 1 | 2 | 37 | SEQ ID NO. 5024 |
| (N20)NGG | 2 | 98349614 | + | GGAGTATCTGAAGCTGAAGGCGG | 1 | 8 | 102 | SEQ ID NO. 5025 |
| (N20)NGG | 2 | 98349618 | + | TATCTGAAGCTGAAGGCGGACGG | 1 | 1 | 26 | SEQ ID NO. 5026 |
| (N20)NGG | 2 | 98349619 | + | ATCTGAAGCTGAAGGCGGACGGG | 1 | 1 | 15 | SEQ ID NO. 5027 |
| (N20)NGG | 2 | 98349638 | + | CGGGCTCATCTACTGCCTGAAGG | 1 | 2 | 15 | SEQ ID NO. 5028 |

FIG. 15 cont.

| site type | site_chromosome | site_start_nucleotide | site_strand | target_site_sequence_with NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 2 | 98349641 | + | GCTCATCTACTGCCTGAAGGAGG | 1 | 1 | 25 | SEQ ID NO. | 5029 |
| (N20)NGG | 2 | 98349675 | + | AGCAGTGCCAGCAACGCCTCAGG | 1 | 2 | 25 | SEQ ID NO. | 5030 |
| (N20)NGG | 2 | 98349681 | + | GCCAGCAACGCCTCAGTGACGG | 1 | 2 | 27 | SEQ ID NO. | 5031 |
| (N20)NGG | 2 | 98349688 | + | ACGCCTCAGTGACGCCAGCAGG | 1 | 2 | 18 | SEQ ID NO. | 5032 |
| (N20)NGG | 2 | 98349691 | + | CCTCAGTGACGGCAGCAGGCGG | 1 | 8 | 67 | SEQ ID NO. | 5033 |
| (N20)NGG | 2 | 98349692 | + | CTCAGGTGACGGCAGCAGGCGG | 1 | 5 | 55 | SEQ ID NO. | 5034 |
| (N20)NGG | 2 | 98349695 | + | AGTGACGGCAGCAGGCGGCGG | 1 | 1 | 57 | SEQ ID NO. | 5035 |
| (N20)NGG | 2 | 98349696 | + | GGTGACGCGGCAGCAGGCGGCGG | 1 | 3 | 65 | SEQ ID NO. | 5036 |
| (N20)NGG | 2 | 98349699 | + | GACGGCAGCAGGCGGGCGGCGG | 1 | 8 | 90 | SEQ ID NO. | 5037 |
| (N20)NGG | 2 | 98349573 | - | CTCCACCAGCTGCAGGAGCAGG | 1 | 9 | 119 | SEQ ID NO. | 5038 |
| (N20)NGG | 2 | 98349579 | - | CAGATACTCCACCAGCTGCAGG | 1 | 6 | 51 | SEQ ID NO. | 5039 |
| (N20)NGG | 2 | 98349580 | - | TCAGATACTCCACCAGCTGCAG | 1 | 2 | 30 | SEQ ID NO. | 5040 |
| (N20)NGG | 2 | 98349631 | - | TGTTGGGGCAGGCCTCCTTCAGG | 1 | 3 | 55 | SEQ ID NO. | 5041 |
| (N20)NGG | 2 | 98349642 | - | GCTGGCACTGCTGTTGGGGCAGG | 2 | 14 | 102 | SEQ ID NO. | 5042 |
| (N20)NGG | 2 | 98349646 | - | CGTTGCTGGCACTGCTGTTGGGG | 1 | 3 | 37 | SEQ ID NO. | 5043 |
| (N20)NGG | 2 | 98349647 | - | GCGTTGCTGGCACTGCTGTTGGG | 1 | 2 | 10 | SEQ ID NO. | 5044 |
| (N20)NGG | 2 | 98349648 | - | GGCGTTGCTGGCACTGCTGTTGG | 1 | 2 | 37 | SEQ ID NO. | 5045 |
| (N20)NGG | 2 | 98349660 | - | GCCGTCACCTGAGGCGTTGCTGG | 1 | 3 | 7 | SEQ ID NO. | 5046 |
| (N20)NGG | 2 | 98349669 | - | CCGCCTGCGTCACCTGAGG | 2 | 2 | 41 | SEQ ID NO. | 5047 |
| (N20)NGG | 2 | 98349759 | + | ACTGTCCCTTCTGCTCCCCCAGG | 1 | 2 | 83 | SEQ ID NO. | 5048 |
| (N20)NGG | 2 | 98349760 | + | CTGTCCCTTCTGCTCCCCCAGGG | 1 | 15 | 191 | SEQ ID NO. | 5049 |
| (N20)NGG | 2 | 98349761 | + | TGTCCCTTCTGCTCCCCCAGGGG | 1 | 9 | 119 | SEQ ID NO. | 5050 |
| (N20)NGG | 2 | 98349814 | + | CCAACGTTGACTCATGTGAGTTGG | 1 | 1 | 15 | SEQ ID NO. | 5051 |
| (N20)NGG | 2 | 98349815 | + | CACGTTGACTCATGTGAGTTGGG | 1 | 1 | 21 | SEQ ID NO. | 5052 |
| (N20)NGG | 2 | 98349816 | + | ACGTTGACTCATGTGAGTTGGGG | 1 | 1 | 11 | SEQ ID NO. | 5053 |
| (N20)NGG | 2 | 98349817 | + | CGTTGACTCATGTGAGTTGGGGG | 1 | 1 | 14 | SEQ ID NO. | 5054 |
| (N20)NGG | 2 | 98349824 | + | TCATGTGAGTTGGGGGCACCTGG | 1 | 3 | 19 | SEQ ID NO. | 5055 |
| (N20)NGG | 2 | 98349742 | - | CAGCCCCTGGGGGAGCAGAAGGG | 3 | 9 | 111 | SEQ ID NO. | 5056 |
| (N20)NGG | 2 | 98349743 | - | GCAGCCCCTGGGGGAGCAGAAGG | 1 | 17 | 144 | SEQ ID NO. | 5057 |
| (N20)NGG | 2 | 98349752 | - | GTGGGAGCAGCAGCCCCTGGGGG | 2 | 13 | 169 | SEQ ID NO. | 5058 |
| (N20)NGG | 2 | 98349753 | - | TGTGGGAGCAGCAGCCCCTGGGG | 4 | 17 | 142 | SEQ ID NO. | 5059 |
| (N20)NGG | 2 | 98349754 | - | GTGTGGGAGCAGCAGCCCCTGGG | 2 | 10 | 79 | SEQ ID NO. | 5060 |
| (N20)NGG | 2 | 98349755 | - | AGTGTGGGAGCAGCAGCCCCTGG | 1 | 7 | 80 | SEQ ID NO. | 5061 |

FIG. 15 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 2 | 98349770 | - | GATGGGTGGGCTGGGAGTGTGGG | | 1 | 13 | 158 SEQ ID NO. 5062 |
| (N20)NGG | 2 | 98349771 | - | GGATGGGTGGGCTGGGAGTGTGG | | 3 | 30 | 323 SEQ ID NO. 5063 |
| (N20)NGG | 2 | 98349778 | - | TCAACGTGGATGGGTGGGCTGGG | | 1 | 3 | 15 SEQ ID NO. 5064 |
| (N20)NGG | 2 | 98349779 | - | GTCAACGTGGATGGGTGGGCTGG | | 1 | 1 | 22 SEQ ID NO. 5065 |
| (N20)NGG | 2 | 98349783 | - | ATGAGTCAACGTGGATGGGTGGG | | 1 | 2 | 16 SEQ ID NO. 5066 |
| (N20)NGG | 2 | 98349784 | - | CATGAGTCAACGTGGATGGGTGG | | 1 | 2 | 20 SEQ ID NO. 5067 |
| (N20)NGG | 2 | 98349787 | - | TCACATGAGTCAACGTGGATGGG | | 1 | 2 | 22 SEQ ID NO. 5068 |
| (N20)NGG | 2 | 98349788 | - | CTCACATGAGTCAACGTGGATGG | | 1 | 1 | 29 SEQ ID NO. 5069 |
| (N20)NGG | 2 | 98349792 | - | CCAACTCACATGAGTCAACGTGG | | 1 | 1 | 14 SEQ ID NO. 5070 |
| (N20)NGG | 2 | 98350040 | + | ATGCACACCCTCAACTCAGATGG | | 1 | 1 | 8 SEQ ID NO. 5071 |
| (N20)NGG | 2 | 98350058 | + | GATGGATACACCCTGAGCCAGG | | 1 | 2 | 16 SEQ ID NO. 5072 |
| (N20)NGG | 2 | 98350065 | + | ACACCCCTGAGCCAGGTGAGCGG | | 2 | 9 | 67 SEQ ID NO. 5073 |
| (N20)NGG | 2 | 98350066 | + | CACCCCTGAGCCAGGTGAGCGGG | | 1 | 7 | 84 SEQ ID NO. 5074 |
| (N20)NGG | 2 | 98350072 | + | TGAGCCAGGTGAGCGGGCAGAGG | | 3 | 13 | 83 SEQ ID NO. 5075 |
| (N20)NGG | 2 | 98350075 | + | GCCAGGTGAGCGGGCAGAGGTGG | | 1 | 7 | 113 SEQ ID NO. 5076 |
| (N20)NGG | 2 | 98350076 | + | CCAGGTGAGCGGGCAGAGGTGGG | | 1 | 5 | 102 SEQ ID NO. 5077 |
| (N20)NGG | 2 | 98350077 | + | CAGGTGAGCGGGCAGAGGTGGGG | | 1 | 21 | 161 SEQ ID NO. 5078 |
| (N20)NGG | 2 | 98349982 | - | TAAAGGCCACACAGGGTCAGCAAGG | | 1 | 5 | 59 SEQ ID NO. 5079 |
| (N20)NGG | 2 | 98349991 | - | CTCTGAGGCTAAAGGCCACAGGG | | 1 | 1 | 57 SEQ ID NO. 5080 |
| (N20)NGG | 2 | 98349992 | - | TCTCTGAGGCTAAAGGCCACAGG | | 1 | 5 | 54 SEQ ID NO. 5081 |
| (N20)NGG | 2 | 98349999 | - | CGATTCGTCTCTGAGGCTAAAGG | | 1 | 1 | 6 SEQ ID NO. 5082 |
| (N20)NGG | 2 | 98350006 | - | AGGTGTCGATTCGTCTCTGAGG | | 1 | 1 | 9 SEQ ID NO. 5083 |
| (N20)NGG | 2 | 98350025 | - | GGTGTATCCATCTGAGTTGAGGG | | 1 | 2 | 18 SEQ ID NO. 5084 |
| (N20)NGG | 2 | 98350026 | - | GGGTGTATCCATCTGAGTTGAGG | | 1 | 2 | 13 SEQ ID NO. 5085 |
| (N20)NGG | 2 | 98350046 | - | TGCCCGCTCACCTGGCTCAGGGG | | 2 | 10 | 61 SEQ ID NO. 5086 |
| (N20)NGG | 2 | 98350047 | - | CTGCCCGCTCACCTGGCTCAGGG | | 5 | 7 | 48 SEQ ID NO. 5087 |
| (N20)NGG | 2 | 98350048 | - | TCTGCCCGCTCACCTGGCTCAGG | | 1 | 3 | 45 SEQ ID NO. 5088 |
| (N20)NGG | 2 | 98350054 | - | CCCACCTCTGCCCGCTCACCTGG | | 1 | 6 | 108 SEQ ID NO. 5089 |
| (N20)NGG | 2 | 98351010 | + | TAACGTCCCAGACAAACCGCGG | | 1 | 1 | 10 SEQ ID NO. 5090 |
| (N20)NGG | 2 | 98351023 | + | CAAACCGCGGCGATGCCCATGG | | 1 | 1 | 3 SEQ ID NO. 5091 |
| (N20)NGG | 2 | 98351062 | + | GAGCCCTACAGCGACCCAGAGG | | 1 | 4 | 27 SEQ ID NO. 5092 |
| (N20)NGG | 2 | 98351071 | + | CAGCGACCCAGAGGAGCTCAAGG | | 2 | 2 | 45 SEQ ID NO. 5093 |
| (N20)NGG | 2 | 98351126 | + | CTCATAGCTGACATTGAACTTGG | | 1 | 9 | 44 SEQ ID NO. 5094 |

FIG. 15 cont.

| site type | site chromosome | site start nucleotide | site strand | target_site_sequence with NGG | genome_wide_hits with 1 or less mismatches | genome_wide_hits with 2 or less mismatches | genome_wide_hits with 3 or less mismatches | | |
|---|---|---|---|---|---|---|---|---|---|
| (N20)NGG | 2 | 98351132 | + | GCTGACATTGAACTTGGCTGCGG | 1 | | 51 | SEQ ID NO. | 5095 |
| (N20)NGG | 2 | 98351141 | + | GAACTTGGCTGCGGCAACTTTGG | 1 | 1 | 18 | SEQ ID NO. | 5096 |
| (N20)NGG | 2 | 98351155 | + | CAACTTTGGCTCAGTGCGCCAGG | 1 | 1 | 10 | SEQ ID NO. | 5097 |
| (N20)NGG | 2 | 98351156 | + | AACTTTGGCTCAGTGCGCCAGGG | 1 | 1 | 9 | SEQ ID NO. | 5098 |
| (N20)NGG | 2 | 98351180 | + | GTGTACCGCATGCGCAAGTATGG | 1 | 1 | 2 | SEQ ID NO. | 5099 |
| (N20)NGG | 2 | 98351195 | + | AAGTATGGCCGCCCCTGCCGTGG | 1 | 1 | 5 | SEQ ID NO. | 5100 |
| (N20)NGG | 2 | 98351198 | + | TATGGCCGCCCCTGCCGTGGTGG | 1 | 1 | 8 | SEQ ID NO. | 5101 |
| (N20)NGG | 2 | 98351199 | + | ATGGCCGCCCCTGCCGTGGTGGG | 1 | 1 | 11 | SEQ ID NO. | 5102 |
| (N20)NGG | 2 | 98350965 | - | TGCGTGCTGGGCACACACAGCCG | 2 | 11 | 66 | SEQ ID NO. | 5103 |
| (N20)NGG | 2 | 98350977 | - | CTGGGACGTTATGCGTGCTGGG | 1 | 1 | 5 | SEQ ID NO. | 5104 |
| (N20)NGG | 2 | 98350978 | - | TCTGGGACGTTATGCGTGCTGG | 1 | 1 | 4 | SEQ ID NO. | 5105 |
| (N20)NGG | 2 | 98350994 | - | CATCGGCGCGGTTTGTCTGGG | 1 | 1 | 4 | SEQ ID NO. | 5106 |
| (N20)NGG | 2 | 98350995 | - | GCATCGGCGCGCGGTTTGTCTGG | 1 | 1 | 1 | SEQ ID NO. | 5107 |
| (N20)NGG | 2 | 98350996 | - | GGCATCGGCGCGCGGTTTGTCTG | 1 | 1 | 4 | SEQ ID NO. | 5108 |
| (N20)NGG | 2 | 98351005 | - | GTGTCCATGGGCATCGGCGCGG | 1 | 2 | 14 | SEQ ID NO. | 5109 |
| (N20)NGG | 2 | 98351011 | - | ACGCTGTGTCCATGGGCATCGG | 1 | 3 | 8 | SEQ ID NO. | 5110 |
| (N20)NGG | 2 | 98351017 | - | TCATACACGCTCGTGTCCATGG | 1 | 1 | 3 | SEQ ID NO. | 5111 |
| (N20)NGG | 2 | 98351018 | - | CTCATACACGCTCGTGTCCATG | 1 | 1 | 4 | SEQ ID NO. | 5112 |
| (N20)NGG | 2 | 98351043 | - | GCTCCTCTGGGTCGCTGTAGGGG | 1 | 1 | 17 | SEQ ID NO. | 5113 |
| (N20)NGG | 2 | 98351044 | - | AGCTCCTCTGGGTCGCTGTAGG | 1 | 1 | 14 | SEQ ID NO. | 5114 |
| (N20)NGG | 2 | 98351045 | - | GAGCTCCTCTGGGTCGCTGTAG | 2 | 1 | 18 | SEQ ID NO. | 5115 |
| (N20)NGG | 2 | 98351055 | - | TCTTGTCCTTGAGCTCCTCTGG | 1 | 4 | 50 | SEQ ID NO. | 5116 |
| (N20)NGG | 2 | 98351056 | - | TTCTTGTCCTTGAGCTCCTCTG | 1 | 4 | 76 | SEQ ID NO. | 5117 |
| (N20)NGG | 2 | 98351085 | - | TGAGGAGGTTATCGCGCTTCAGG | 1 | 1 | 5 | SEQ ID NO. | 5118 |
| (N20)NGG | 2 | 98351100 | - | GTTCAATGTCAGCTATGAGGAGG | 2 | 2 | 39 | SEQ ID NO. | 5119 |
| (N20)NGG | 2 | 98351103 | - | CAAGTTCAATGTCAGCTATGAGG | 1 | 4 | 82 | SEQ ID NO. | 5120 |
| (N20)NGG | 2 | 98351151 | - | TGCGCATGCGGTACACGCCCTGG | 1 | 1 | 6 | SEQ ID NO. | 5121 |
| (N20)NGG | 2 | 98351163 | - | GGCGGCCATACTTGCGCATGCGG | 1 | 1 | 3 | SEQ ID NO. | 5122 |
| (N20)NGG | 2 | 98351712 | + | CTCCGTGGCCGGTCGGGCAGG | 1 | 4 | 22 | SEQ ID NO. | 5123 |
| (N20)NGG | 2 | 98351728 | + | GGGCAGGAAGCAGATCGACGTGG | 1 | 1 | 11 | SEQ ID NO. | 5124 |
| (N20)NGG | 2 | 98351737 | + | GCAGATCGACGTGGCCATCAAGG | 1 | 1 | 12 | SEQ ID NO. | 5125 |
| (N20)NGG | 2 | 98351749 | + | GGCCATCAAGGTCGTGAAGCAGG | 1 | 3 | 46 | SEQ ID NO. | 5126 |
| (N20)NGG | 2 | 98351750 | + | GCCATCAAGGTCGTGAAGCAGGG | 1 | 4 | 59 | SEQ ID NO. | 5127 |

FIG. 15 cont.

| site_type | site_chromosome | site_start_nucleotide | site_strand | target_site_sequence_with NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 2 | 98351755 | + | CAAGGTGCTGAAGCAGGGCACCG | 1 | | 6 | 83 SEQ ID NO. 5128 |
| (N20)NGG | 2 | 98351761 | + | GCTGAAGCAGGGCACGGAGAAGG | 1 | | 5 | 75 SEQ ID NO. 5129 |
| (N20)NGG | 2 | 98351770 | + | GGGCACGGAGAAGGCAGACACGG | 2 | | 6 | 109 SEQ ID NO. 5130 |
| (N20)NGG | 2 | 98351788 | + | CACGGAAAGATGATGCGCAGG | 1 | | 1 | 6 SEQ ID NO. 5131 |
| (N20)NGG | 2 | 98351809 | + | GGGCAGATCATGCACCAGCTGG | 1 | | 1 | 11 SEQ ID NO. 5132 |
| (N20)NGG | 2 | 98351829 | + | TGGACAACCCTACATCGTCGG | 2 | | 2 | 12 SEQ ID NO. 5133 |
| (N20)NGG | 2 | 98351837 | + | CCCTACATCGTCGGGCTCATTGG | 1 | | 2 | 8 SEQ ID NO. 5134 |
| (N20)NGG | 2 | 98351848 | + | GCGGCTCATTGGCGTCTGCCAGG | 1 | | 1 | 7 SEQ ID NO. 5135 |
| (N20)NGG | 2 | 98351854 | + | CATTGGCGTCTGCCAGGCCGAGG | 1 | | 1 | 13 SEQ ID NO. 5136 |
| (N20)NGG | 2 | 98351866 | + | CCAGGCCGAGGCCCTCATGCTGG | 1 | | 4 | 40 SEQ ID NO. 5137 |
| (N20)NGG | 2 | 98351872 | + | CGAGGCCCTCATGCTGGTCATGG | 1 | | 5 | 28 SEQ ID NO. 5138 |
| (N20)NGG | 2 | 98351878 | + | CCTCATGCTGGTCATGGAGATGG | 1 | | 3 | 47 SEQ ID NO. 5139 |
| (N20)NGG | 2 | 98351882 | + | ATGCTGGTCATGGAGATGGCTGG | 1 | | 5 | 46 SEQ ID NO. 5140 |
| (N20)NGG | 2 | 98351883 | + | TGCTGGTCATGGAGATGGCTGGG | 1 | | 2 | 54 SEQ ID NO. 5141 |
| (N20)NGG | 2 | 98351884 | + | GCTGGTCATGGAGATGGCTGGGG | 1 | | 6 | 80 SEQ ID NO. 5142 |
| (N20)NGG | 2 | 98351885 | + | CTGGTCATGGAGATGGCTGGGGG | 1 | | 4 | 70 SEQ ID NO. 5143 |
| (N20)NGG | 2 | 98351888 | + | GTCATGGAGATGGCTGGGGGCGG | 1 | | 7 | 115 SEQ ID NO. 5144 |
| (N20)NGG | 2 | 98351889 | + | TCATGGAGATGGCTGGGGGCGGG | 1 | | 8 | 89 SEQ ID NO. 5145 |
| (N20)NGG | 2 | 98351908 | + | CGGGCCGCTGCACAAGTTCCTGG | 1 | | 2 | 7 SEQ ID NO. 5146 |
| (N20)NGG | 2 | 98351912 | + | CCGCTGCACAAGTTCCTGGTCGG | 1 | | 1 | 14 SEQ ID NO. 5147 |
| (N20)NGG | 2 | 98351919 | + | ACAAGTTCCTGGTCGGCAAGAGG | 1 | | 2 | 23 SEQ ID NO. 5148 |
| (N20)NGG | 2 | 98351929 | + | GGTCGGCAAGAGGTGAGCACCGG | 2 | | 5 | 15 SEQ ID NO. 5149 |
| (N20)NGG | 2 | 98351930 | + | GTCGGCAAGAGGTGAGCACCGGG | 1 | | 1 | 16 SEQ ID NO. 5150 |
| (N20)NGG | 2 | 98351933 | + | GGCAAGAGGTGAGCACCGGGTGG | 1 | | 6 | 79 SEQ ID NO. 5151 |
| (N20)NGG | 2 | 98351934 | + | GCAAGAGGTGAGCACCGGGTGGG | 2 | | 52 | 403 SEQ ID NO. 5152 |
| (N20)NGG | 2 | 98351939 | + | AGGTGAGCACCGGGTGGGCCCGG | 2 | | 3 | 70 SEQ ID NO. 5153 |
| (N20)NGG | 2 | 98351689 | - | CTGCCCGACCCGGCCACGGGAGG | 1 | | 4 | 29 SEQ ID NO. 5154 |
| (N20)NGG | 2 | 98351692 | - | TTCCTGCCCGACCCGGCCACCGG | 1 | | 3 | 22 SEQ ID NO. 5155 |
| (N20)NGG | 2 | 98351693 | - | CTTCCTGCCCGACCCGGCCACGG | 1 | | 2 | 31 SEQ ID NO. 5156 |
| (N20)NGG | 2 | 98351699 | - | GATCTGCTTCCTGCCCGACCCGG | 1 | | 2 | 16 SEQ ID NO. 5157 |
| (N20)NGG | 2 | 98351729 | - | GCCCTGCTTCAGCACCTTGATGG | 1 | | 12 | 54 SEQ ID NO. 5158 |
| (N20)NGG | 2 | 98351802 | - | CGATGTAGGGTTGTCCAGCTGG | 1 | | 2 | 14 SEQ ID NO. 5159 |
| (N20)NGG | 2 | 98351814 | - | CAATGAGCCGCACGATGTAGGGG | 1 | | 2 | 10 SEQ ID NO. 5160 |

FIG. 15 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 2 | 98351815 | - | CCAATGAGCCGCACGATGTAGGG | | 1 | 2 | 7 SEQ ID NO. 5161 |
| (N20)NGG | 2 | 98351816 | - | GCCAATGAGCCGCACGATGTAGG | | 1 | 2 | 6 SEQ ID NO. 5162 |
| (N20)NGG | 2 | 98351844 | - | CCAGCATGAGGGCCTCGGCCTGG | | 2 | 4 | 42 SEQ ID NO. 5163 |
| (N20)NGG | 2 | 98351849 | - | CATGACCAGCATGAGGGCCTCGG | | 5 | 9 | 61 SEQ ID NO. 5164 |
| (N20)NGG | 2 | 98351855 | - | CATCTCATGACCAGCATGAGGG | | 1 | 6 | 51 SEQ ID NO. 5165 |
| (N20)NGG | 2 | 98351856 | - | CCATCTCATGACCAGCATGAGG | | 1 | 3 | 58 SEQ ID NO. 5166 |
| (N20)NGG | 2 | 98351890 | - | CCGACCAGAACTTGTGCAGCGG | | 1 | 1 | 11 SEQ ID NO. 5167 |
| (N20)NGG | 2 | 98351904 | - | GTGCTCACCTCTTGCCGACCAGG | | 1 | 2 | 13 SEQ ID NO. 5168 |
| (N20)NGG | 2 | 98353935 | + | CCCGCCTTCCCCGCCACCCCAGG | | 1 | 18 | 237 SEQ ID NO. 5169 |
| (N20)NGG | 2 | 98353936 | + | CCGCCTTCCCCGCCACCCCAGGG | | 1 | 12 | 127 SEQ ID NO. 5170 |
| (N20)NGG | 2 | 98353939 | + | CCTTCCCCGCCACCCCAGGGAGG | | 1 | 18 | 120 SEQ ID NO. 5171 |
| (N20)NGG | 2 | 98353960 | + | GGAGATCCCTGTGAGCAATGTGG | | 1 | 2 | 40 SEQ ID NO. 5172 |
| (N20)NGG | 2 | 98353978 | + | TGTGGCCGAGCTGCTGCACCAGG | | 1 | 4 | 32 SEQ ID NO. 5173 |
| (N20)NGG | 2 | 98353987 | + | GCTGCTGCACCAGGTGTCCATGG | | 1 | 4 | 54 SEQ ID NO. 5174 |
| (N20)NGG | 2 | 98353988 | + | CTGCTGCACCAGGTGTCCATGGG | | 1 | 3 | 44 SEQ ID NO. 5175 |
| (N20)NGG | 2 | 98353989 | + | TGCTGCACCAGGTGTCCATGGGG | | 1 | 2 | 43 SEQ ID NO. 5176 |
| (N20)NGG | 2 | 98354002 | + | GTCCATGGGGATGAAGTACCTGG | | 1 | 1 | 14 SEQ ID NO. 5177 |
| (N20)NGG | 2 | 98354005 | + | CATGGGGATGAAGTACCTGGAGG | | 1 | 5 | 46 SEQ ID NO. 5178 |
| (N20)NGG | 2 | 98354032 | + | GAACTTTGTGCACCGTGACCTGG | | 2 | 5 | 25 SEQ ID NO. 5179 |
| (N20)NGG | 2 | 98354035 | + | CTTTGTGCACCGTGACCTGGCGG | | 1 | 3 | 28 SEQ ID NO. 5180 |
| (N20)NGG | 2 | 98354053 | + | GGCGGCCCGCAACGTCCTGCTGG | | 1 | 1 | 10 SEQ ID NO. 5181 |
| (N20)NGG | 2 | 98354061 | + | GCAACGTCCTGCTGGTTAACCGG | | 1 | 1 | 5 SEQ ID NO. 5182 |
| (N20)NGG | 2 | 98354087 | + | TACGCCAAGATCAGCGACTTTGG | | 1 | 2 | 4 SEQ ID NO. 5183 |
| (N20)NGG | 2 | 98354104 | + | CTTTGGCCTTCCAAAGCACTGG | | 3 | 15 | 103 SEQ ID NO. 5184 |
| (N20)NGG | 2 | 98354105 | + | TTTGGCCTTCCAAAGCACTGGG | | 2 | 15 | 169 SEQ ID NO. 5185 |
| (N20)NGG | 2 | 98353912 | - | CTGGGGTGGCGGGGAAGGCGGGG | | 2 | 10 | 188 SEQ ID NO. 5186 |
| (N20)NGG | 2 | 98353913 | - | CCTGGGGTGGCGGGGAAGGCGGG | | 1 | 11 | 172 SEQ ID NO. 5187 |
| (N20)NGG | 2 | 98353914 | - | CCCTGGGGTGGCGGGGAAGGCGG | | 1 | 13 | 216 SEQ ID NO. 5188 |
| (N20)NGG | 2 | 98353917 | - | CCTCCCTGGGGTGGCGGGAAGG | | 1 | 14 | 129 SEQ ID NO. 5189 |
| (N20)NGG | 2 | 98353921 | - | ATCTCCTCCCTGGGGTGGCGGGG | | 1 | 3 | 59 SEQ ID NO. 5190 |
| (N20)NGG | 2 | 98353922 | - | GATCTCCTCCCTGGGGTGGCGGG | | 1 | 3 | 48 SEQ ID NO. 5191 |
| (N20)NGG | 2 | 98353923 | - | GGATCTCCTCCCTGGGGTGGCGG | | 1 | 8 | 75 SEQ ID NO. 5192 |
| (N20)NGG | 2 | 98353926 | - | CAGGGATCTCCTCCCTGGGGTGG | | 3 | 6 | 79 SEQ ID NO. 5193 |

FIG. 15 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 2 | 98353929 | - | TCACAGGGATCTCCTCCCTGGGG | | 1 | 4 | 63 | SEQ ID NO. 5194 |
| (N20)NGG | 2 | 98353930 | - | CTCACAGGGATCTCCTCCCTGGG | | 1 | 4 | 54 | SEQ ID NO. 5195 |
| (N20)NGG | 2 | 98353931 | - | GCTCACAGGGATCTCCTCCCTGG | | 1 | 3 | 66 | SEQ ID NO. 5196 |
| (N20)NGG | 2 | 98353944 | - | GCTCGGCCACATTGCTCACAGGG | | 1 | 2 | 15 | SEQ ID NO. 5197 |
| (N20)NGG | 2 | 98353945 | - | AGCTCGGCCACATTGCTCACAGG | | 1 | 2 | 11 | SEQ ID NO. 5198 |
| (N20)NGG | 2 | 98353961 | - | GGACACCTGGTGCAGCAGCTCGG | | 1 | 1 | 44 | SEQ ID NO. 5199 |
| (N20)NGG | 2 | 98353974 | - | ACTTCATCCCCATGGACACCTGG | | 1 | 1 | 34 | SEQ ID NO. 5200 |
| (N20)NGG | 2 | 98353982 | - | CTCCAGGTACTTCATCCCCATGG | | 1 | 3 | 62 | SEQ ID NO. 5201 |
| (N20)NGG | 2 | 98353998 | - | GCACAAAGTTCTTCTCCTCCAGG | | 1 | 1 | 59 | SEQ ID NO. 5202 |
| (N20)NGG | 2 | 98354022 | - | CGTTGCGGGCCGCCAGGTCACGG | | 1 | 4 | 17 | SEQ ID NO. 5203 |
| (N20)NGG | 2 | 98354028 | - | GCAGGACGTTGCGGGCCGCCAGG | | 1 | 2 | 12 | SEQ ID NO. 5204 |
| (N20)NGG | 2 | 98354036 | - | GTTAACCAGCAGGACGTTGCGGG | | 1 | 1 | 8 | SEQ ID NO. 5205 |
| (N20)NGG | 2 | 98354037 | - | GGTTAACCAGCAGGACGTTGCGG | | 1 | 2 | 13 | SEQ ID NO. 5206 |
| (N20)NGG | 2 | 98354046 | - | CGTAGTGCCGGTTAACCAGCAGG | | 1 | 1 | 4 | SEQ ID NO. 5207 |
| (N20)NGG | 2 | 98354058 | - | CGCTGATCTTGGCGTAGTGCCGG | | 1 | 1 | 5 | SEQ ID NO. 5208 |
| (N20)NGG | 2 | 98354069 | - | GAGGCCAAAGTCGCTGATCTTGG | | 1 | 4 | 21 | SEQ ID NO. 5209 |
| (N20)NGG | 2 | 98354088 | - | CGGCACCCAGTGCTTTGGAGAGG | | 1 | 1 | 22 | SEQ ID NO. 5210 |
| (N20)NGG | 2 | 98354093 | - | GTCGTCGGCACCCAGTGCTTTGG | | 1 | 1 | 2 | SEQ ID NO. 5211 |
| (N20)NGG | 2 | 98354108 | - | TACAGTGTAGTAGCTGTGTCGTCGG | | 1 | 1 | 6 | SEQ ID NO. 5212 |
| (N20)NGG | 2 | 98354219 | + | AGCAGCATCTCCCCCTCCCCAGG | | 1 | 12 | 172 | SEQ ID NO. 5213 |
| (N20)NGG | 2 | 98354232 | + | CCTCCCCAGGCCCGCTCAGCAGG | | 2 | 5 | 89 | SEQ ID NO. 5214 |
| (N20)NGG | 2 | 98354233 | + | CTCCCCAGGCCCGCTCAGCAGGG | | 2 | 3 | 65 | SEQ ID NO. 5215 |
| (N20)NGG | 2 | 98354239 | + | AGGCCCGCTCAGCAGGGAAGTGG | | 1 | 9 | 57 | SEQ ID NO. 5216 |
| (N20)NGG | 2 | 98354251 | + | CAGGGAAGTGGCCGCTCAAGTGG | | 1 | 2 | 25 | SEQ ID NO. 5217 |
| (N20)NGG | 2 | 98354305 | + | TCTCCAGCCGCAGCGATGTCTGG | | 1 | 1 | 16 | SEQ ID NO. 5218 |
| (N20)NGG | 2 | 98354313 | + | CGCAGCGATGTCTGGAGCTATGG | | 1 | 3 | 16 | SEQ ID NO. 5219 |
| (N20)NGG | 2 | 98354314 | + | GCAGCGATGTCTGGAGCTATGGG | | 1 | 1 | 18 | SEQ ID NO. 5220 |
| (N20)NGG | 2 | 98354315 | + | CAGCGATGTCTGGAGCTATGGGG | | 1 | 2 | 22 | SEQ ID NO. 5221 |
| (N20)NGG | 2 | 98354326 | + | GGAGCTATGGGGTCACCATGTGG | | 1 | 4 | 27 | SEQ ID NO. 5222 |
| (N20)NGG | 2 | 98354327 | + | GAGCTATGGGGTCACCATGTGGG | | 1 | 4 | 146 | SEQ ID NO. 5223 |
| (N20)NGG | 2 | 98354330 | + | CTATGGGGTCACCATGTGGGAGG | | 1 | 4 | 33 | SEQ ID NO. 5224 |
| (N20)NGG | 2 | 98354343 | + | ATGTGGGAGGCCTTGTCCTACGG | | 1 | 4 | 43 | SEQ ID NO. 5225 |
| (N20)NGG | 2 | 98354360 | + | CTACGGCCAGAAGCCCTACAAGG | | 1 | 1 | 15 | SEQ ID NO. 5226 |

FIG. 15 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | |
|---|---|---|---|---|---|---|---|---|
| (N20)NGG | 2 | 98354364 | + | GGCCAGAAGCCCTACAAGGCAGG | 1 | 1 | 28 | SEQ ID NO. 5227 |
| (N20)NGG | 2 | 98354369 | + | GAAGCCCTACAAGGCAGGCGCGG | 1 | 1 | 29 | SEQ ID NO. 5228 |
| (N20)NGG | 2 | 98354370 | + | AAGCCCTACAAGGCAGGCGCGGG | 1 | 3 | 29 | SEQ ID NO. 5229 |
| (N20)NGG | 2 | 98354376 | + | TACAAGGCAGGCGCGGGCAGAGG | 1 | 1 | 24 | SEQ ID NO. 5230 |
| (N20)NGG | 2 | 98354380 | + | AGGCAGGCGCGGGCAGAGGCAGG | 2 | 10 | 164 | SEQ ID NO. 5231 |
| (N20)NGG | 2 | 98354383 | + | CAGGCGCGGGCAGAGGCAGGTGG | 1 | 13 | 325 | SEQ ID NO. 5232 |
| (N20)NGG | 2 | 98354384 | + | AGGCGCGGGCAGAGGCAGGTGGG | 2 | 7 | 89 | SEQ ID NO. 5233 |
| (N20)NGG | 2 | 98354195 | - | TGGGGAGGGGAGATGCTGCTGG | 2 | 16 | 233 | SEQ ID NO. 5234 |
| (N20)NGG | 2 | 98354207 | - | GCTGAGCGGGCCTGGGGAGGGGG | 1 | 11 | 178 | SEQ ID NO. 5235 |
| (N20)NGG | 2 | 98354208 | - | TGCTGAGCGGGCCTGGGGAGGGG | 1 | 6 | 97 | SEQ ID NO. 5236 |
| (N20)NGG | 2 | 98354209 | - | CTGCTGAGCGGGCCTGGGGAGG | 1 | 8 | 98 | SEQ ID NO. 5237 |
| (N20)NGG | 2 | 98354210 | - | CCTGCTGAGCGGGCCTGGGGAGG | 2 | 6 | 88 | SEQ ID NO. 5238 |
| (N20)NGG | 2 | 98354213 | - | TTCCCTGCTGAGCGGGCCTGGGG | 2 | 5 | 35 | SEQ ID NO. 5239 |
| (N20)NGG | 2 | 98354214 | - | CTTCCCTGCTGAGCGGGCCTGGG | 1 | 4 | 29 | SEQ ID NO. 5240 |
| (N20)NGG | 2 | 98354215 | - | ACTTCCCTGCTGAGCGGGCCTGG | 2 | 3 | 19 | SEQ ID NO. 5241 |
| (N20)NGG | 2 | 98354220 | - | CGGCCACTTCCCTGCTGAGCGGG | 1 | 7 | 53 | SEQ ID NO. 5242 |
| (N20)NGG | 2 | 98354221 | - | GCGGCCACTTCCCTGCTGAGCGG | 1 | 2 | 38 | SEQ ID NO. 5243 |
| (N20)NGG | 2 | 98354240 | - | TCGGGTGCGTACCACTTGAGCGG | 1 | 1 | 3 | SEQ ID NO. 5244 |
| (N20)NGG | 2 | 98354258 | - | TTGCGGAAGTTGATGCATTCGG | 1 | 1 | 8 | SEQ ID NO. 5245 |
| (N20)NGG | 2 | 98354259 | - | CTTGCGGAAGTTGATGCATTCGG | 1 | 1 | 14 | SEQ ID NO. 5246 |
| (N20)NGG | 2 | 98354275 | - | CGCTGCGGCTGGAGAACTTGCGG | 1 | 2 | 28 | SEQ ID NO. 5247 |
| (N20)NGG | 2 | 98354286 | - | GCTCCAGACATCGCTGCGGCTGG | 1 | 1 | 18 | SEQ ID NO. 5248 |
| (N20)NGG | 2 | 98354290 | - | CATAGCTCCAGACATCGCTGCGG | 1 | 3 | 32 | SEQ ID NO. 5249 |
| (N20)NGG | 2 | 98354319 | - | GTAGGACAAGGCCTCCCACATGG | 1 | 5 | 35 | SEQ ID NO. 5250 |
| (N20)NGG | 2 | 98354331 | - | GGGCTTCTGCCGTAGGACAAGG | 1 | 1 | 13 | SEQ ID NO. 5251 |
| (N20)NGG | 2 | 98354337 | - | CTTGTAGGGCTTCTGCCGTAGG | 1 | 2 | 30 | SEQ ID NO. 5252 |
| (N20)NGG | 2 | 98354344 | - | CGCCTGCCTTGTAGGGCTTCTGG | 1 | 4 | 32 | SEQ ID NO. 5253 |
| (N20)NGG | 2 | 98354351 | - | TGCCCGCGCCTGCCTTGTAGG | 1 | 1 | 16 | SEQ ID NO. 5254 |
| (N20)NGG | 2 | 98354352 | - | TCTGCCCGCGCCTGCCTTGTAGG | 1 | 1 | 13 | SEQ ID NO. 5255 |
| (N20)NGG | 2 | 98354467 | + | CGGCTTGAGCAGAAGATGAAAGG | 1 | 1 | 28 | SEQ ID NO. 5256 |
| (N20)NGG | 2 | 98354468 | + | GGCTTGAGCAGAAGATGAAAGGG | 1 | 4 | 67 | SEQ ID NO. 5257 |
| (N20)NGG | 2 | 98354472 | + | TGAGCAGAAGATGAAAGGGCCGG | 1 | 13 | 112 | SEQ ID NO. 5258 |
| (N20)NGG | 2 | 98354475 | + | GCAGAAGATGAAAGGGCCGGAGG | 1 | 5 | 89 | SEQ ID NO. 5259 |

FIG. 15 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 2 | 98354481 | + | GATGAAAGGCCGGAGTCATGG |   |   | 3 | 32 | SEQ ID NO. 5260 |
| (N20)NGG | 2 | 98354496 | + | GGTCATGGCCTTCATCGAGCAGG | 1 |   | 1 | 11 | SEQ ID NO. 5261 |
| (N20)NGG | 2 | 98354497 | + | GTCATGGCCTTCATCGAGCAGGG |   | 2 | 3 | 15 | SEQ ID NO. 5262 |
| (N20)NGG | 2 | 98354504 | + | CCTTCATCGAGCAGGGCAAGCGG |   | 1 | 1 | 22 | SEQ ID NO. 5263 |
| (N20)NGG | 2 | 98354508 | + | CATCGAGCAGGGCAAGCGGATGG |   |   | 1 | 9 | SEQ ID NO. 5264 |
| (N20)NGG | 2 | 98354561 | + | ACGCACTCATGAGTGACTGCTGG |   |   | 2 | 16 | SEQ ID NO. 5265 |
| (N20)NGG | 2 | 98354583 | + | GATCTACAAGTGAGTGCCAGTGG |   |   | 1 | 24 | SEQ ID NO. 5266 |
| (N20)NGG | 2 | 98354584 | + | ATCTACAAGTGAGTGCCAGTGGG |   |   | 1 | 15 | SEQ ID NO. 5267 |
| (N20)NGG | 2 | 98354585 | + | TCTACAAGTGAGTGCCAGTGGGG |   |   | 3 | 24 | SEQ ID NO. 5268 |
| (N20)NGG | 2 | 98354588 | + | ACAAGTGAGTGCCAGTGGGGAGG |   | 1 | 5 | 47 | SEQ ID NO. 5269 |
| (N20)NGG | 2 | 98354589 | + | CAAGTGAGTGCCAGTGGGGAGGG |   | 2 | 8 | 87 | SEQ ID NO. 5270 |
| (N20)NGG | 2 | 98354590 | + | AAGTGAGTGCCAGTGGGGAGGGG |   | 1 | 9 | 90 | SEQ ID NO. 5271 |
| (N20)NGG | 2 | 98354442 | - | TTCATCTTCTGCTCAAGCCGGGG |   | 1 | 2 | 24 | SEQ ID NO. 5272 |
| (N20)NGG | 2 | 98354443 | - | TTTCATCTTCTGCTCAAGCCGGG |   | 1 | 2 | 63 | SEQ ID NO. 5273 |
| (N20)NGG | 2 | 98354444 | - | CTTTCATCTTCTGCTCAAGCCGG |   | 1 | 4 | 60 | SEQ ID NO. 5274 |
| (N20)NGG | 2 | 98354469 | - | TCGATGAAGGCCATGACCTCCGG |   | 1 | 2 | 22 | SEQ ID NO. 5275 |
| (N20)NGG | 2 | 98354482 | - | CCGCTTGCCCTGCTCGATGAAGG |   | 1 | 1 | 8 | SEQ ID NO. 5276 |
| (N20)NGG | 2 | 98354513 | - | GTTCGGGTGGACACTTCTGTGGG |   | 1 | 2 | 11 | SEQ ID NO. 5277 |
| (N20)NGG | 2 | 98354514 | - | AGTTCGGGTGGACACTCTGTGG |   | 1 | 1 | 12 | SEQ ID NO. 5278 |
| (N20)NGG | 2 | 98354517 | - | TACAGTTCGGGTGGACACTCTGG |   | 1 | 1 | 6 | SEQ ID NO. 5279 |
| (N20)NGG | 2 | 98354526 | - | ATGAGTGCTACAGTTCGGGTGG |   | 1 | 3 | 8 | SEQ ID NO. 5280 |
| (N20)NGG | 2 | 98354529 | - | CTCAGTAGTGCTACAGTTCGGG |   | 1 | 1 | 10 | SEQ ID NO. 5281 |
| (N20)NGG | 2 | 98354530 | - | ACTCATGAGTGCGTACAGTTCG |   | 1 | 1 | 8 | SEQ ID NO. 5282 |
| (N20)NGG | 2 | 98355837 | + | GGATGTACCCCACGCCCCACAGG |   | 1 | 1 | 14 | SEQ ID NO. 5283 |
| (N20)NGG | 2 | 98355840 | + | TGTACCCCACGCCCCACAGGTGG |   | 1 | 2 | 36 | SEQ ID NO. 5284 |
| (N20)NGG | 2 | 98355841 | + | GTACCCCACGCCCCACAGGTGGG |   | 1 | 1 | 27 | SEQ ID NO. 5285 |
| (N20)NGG | 2 | 98355844 | + | CCCCACGCCCCACAGGTGGGAGG |   | 1 | 6 | 68 | SEQ ID NO. 5286 |
| (N20)NGG | 2 | 98355868 | + | TCGCCCGACTTCCTGACCGTGG |   | 1 | 1 | 11 | SEQ ID NO. 5287 |
| (N20)NGG | 2 | 98355901 | + | GCGAGCCTGTTACTACAGCCTGG |   | 1 | 2 | 9 | SEQ ID NO. 5288 |
| (N20)NGG | 2 | 98355910 | + | TTACTACAGCCTGGCCAGCAAGG |   | 1 | 23 | 811 | SEQ ID NO. 5289 |
| (N20)NGG | 2 | 98355913 | + | CTACAGCCTGGCCAGCAAGGTGG |   | 1 | 8 | 291 | SEQ ID NO. 5290 |
| (N20)NGG | 2 | 98355917 | + | AGCCTGGCCAGCAAGGTGAAGG |   | 1 | 21 | 551 | SEQ ID NO. 5291 |
| (N20)NGG | 2 | 98355918 | + | GCCTGGCCAGCAAGGTGGAAGGG |   | 1 | 18 | 453 | SEQ ID NO. 5292 |

FIG. 15 cont.

| site_type | site_chromosome | site_start_nucleotide | site_strand | target_site_sequence_with_NGG | genome_wide_hits_with_1_or_less_mismatches | genome_wide_hits_with_2_or_less_mismatches | genome_wide_hits_with_3_or_less_mismatches | | |
|---|---|---|---|---|---|---|---|---|---|
| (N20)NGG | 2 | 98355926 | + | AGCAAGGTGAAGGCCCCCAGG | 1 | 3 | 41 | SEQ ID NO. | 5293 |
| (N20)NGG | 2 | 98355940 | + | GCCCCCAGGCAGCACACAGAAGG | 3 | 6 | 109 | SEQ ID NO. | 5294 |
| (N20)NGG | 2 | 98355946 | + | AGGCAGCACACAGAAGGCTGAGG | 1 | 9 | 127 | SEQ ID NO. | 5295 |
| (N20)NGG | 2 | 98355976 | + | TGCCTGAGCTCCCGCTGCCCAGG | 2 | 5 | 59 | SEQ ID NO. | 5296 |
| (N20)NGG | 2 | 98355977 | + | GCCTGAGCTCCCGCTGCCCAGGG | 1 | 10 | 89 | SEQ ID NO. | 5297 |
| (N20)NGG | 2 | 98355978 | + | CCTGAGCTCCCGCTGCCCAGGGG | 1 | 6 | 83 | SEQ ID NO. | 5298 |
| (N20)NGG | 2 | 98355812 | – | GTGGGGCGTGGGGTACATCCAGG | 1 | 1 | 28 | SEQ ID NO. | 5299 |
| (N20)NGG | 2 | 98355822 | – | CCTCCCACCTGTGGGGCGTGGGG | 1 | 3 | 58 | SEQ ID NO. | 5300 |
| (N20)NGG | 2 | 98355823 | – | TCCTCCCACCTGTGGGGCGTGGG | 1 | 2 | 33 | SEQ ID NO. | 5301 |
| (N20)NGG | 2 | 98355824 | – | ATCTCCCACCTGTGGGGCGTGG | 1 | 2 | 30 | SEQ ID NO. | 5302 |
| (N20)NGG | 2 | 98355829 | – | GGGCGATCCTCCCACCTGTGGGG | 1 | 1 | 27 | SEQ ID NO. | 5303 |
| (N20)NGG | 2 | 98355830 | – | GGGGCGATCCTCCCACCTGTGGG | 1 | 2 | 16 | SEQ ID NO. | 5304 |
| (N20)NGG | 2 | 98355831 | – | CGGGGCGATCCTCCCACCTGTGG | 1 | 2 | 28 | SEQ ID NO. | 5305 |
| (N20)NGG | 2 | 98355849 | – | GCTCCACGGTCAGGAAGTCGGGG | 1 | 1 | 13 | SEQ ID NO. | 5306 |
| (N20)NGG | 2 | 98355850 | – | TGCTCCACGGTCAGGAAGTCGG | 1 | 2 | 15 | SEQ ID NO. | 5307 |
| (N20)NGG | 2 | 98355851 | – | CTGCTCCACGGTCAGGAAGTCGG | 1 | 2 | 26 | SEQ ID NO. | 5308 |
| (N20)NGG | 2 | 98355858 | – | GCATGCGCTGCTCCACGGTCAGG | 1 | 2 | 9 | SEQ ID NO. | 5309 |
| (N20)NGG | 2 | 98355863 | – | GGCTCGCATGCGCTGCTCCACGG | 1 | 2 | 11 | SEQ ID NO. | 5310 |
| (N20)NGG | 2 | 98355884 | – | GCTGCCAGGCTGTAGTAACAGG | 1 | 2 | 38 | SEQ ID NO. | 5311 |
| (N20)NGG | 2 | 98355897 | – | GCCCTTCCACCTTGCTGGCCAGG | 1 | 5 | 65 | SEQ ID NO. | 5312 |
| (N20)NGG | 2 | 98355902 | – | TGGGGCCCTTCCACCTTGCTGG | 1 | 3 | 41 | SEQ ID NO. | 5313 |
| (N20)NGG | 2 | 98355919 | – | GCCTTCTGTGTGTGCTGCCTGGGG | 1 | 5 | 102 | SEQ ID NO. | 5314 |
| (N20)NGG | 2 | 98355920 | – | AGCCTTCTGTGTGTGCTGCCTGGG | 1 | 6 | 93 | SEQ ID NO. | 5315 |
| (N20)NGG | 2 | 98355921 | – | CAGCCTTCTGTGTGTGCTGCCTGG | 1 | 7 | 119 | SEQ ID NO. | 5316 |
| (N20)NGG | 2 | 98355922 | – | TCAGCCTTCTGTGTGTGCTGCCTGG | 1 | 5 | 76 | SEQ ID NO. | 5317 |
| (N20)NGG | 2 | 98355950 | – | GGCAGCGGGAGCTCAGGCACAGG | 1 | 6 | 57 | SEQ ID NO. | 5318 |
| (N20)NGG | 2 | 98355956 | – | CCCCTGGGCAGCGGGAGCTCAGG | 1 | 3 | 66 | SEQ ID NO. | 5319 |

FIG. 15 cont.

1 MDKKYSIGLD IGTNSVGWAV ITDEYKVPSK KFKVLGNTDR HSIKKNLIGA LLFDSGETAE

61 ATRLKRTARR RYTRRKNRIC YLQEIFSNEM AKVDDSFFHR LEESFLVEED KKHERHPIFG

121 NIVDEVAYHE KYPTIYHLRK KLVDSTDKAD LRLIYLALAH MIKFRGHFLI EGDLNPDNSD

181 VDKLFIQLVQ TYNQLFEENP INASGVDAKA ILSARLSKSR RLENLIAQLP GEKKNGLFGN

241 LIALSLGLTP NFKSNFDLAE DAKLQLSKDT YDDDLDNLLA QIGDQYADLF LAAKNLSDAI

301 LLSDILRVNT EITKAPLSAS MIKRYDEHHQ DLTLLKALVR QQLPEKYKEI FFDQSKNGYA

361 GYIDGGASQE EFYKFIKPIL EKMDGTEELL VKLNREDLLR KQRTFDNGSI PHQIHLGELH

421 AILRRQEDFY PFLKDNREKI EKILTFRIPY YVGPLARGNS RFAWMTRKSE ETITPWNFEE

481 VVDKGASAQS FIERMTNFDK NLPNEKVLPK HSLLYEYFTV YNELTKVKYV TEGMRKPAFL

541 SGEQKKAIVD LLFKTNRKVT VKQLKEDYFK KIECFDSVEI SGVEDRFNAS LGTYHDLLKI

601 IKDKDFLDNE ENEDILEDIV LTLTLFEDRE MIEERLKTYA HLFDDKVMKQ LKRRRYTGWG

661 RLSRKLINGI RDKQSGKTIL DFLKSDGFAN RNFMQLIHDD SLTFKEDIQK AQVSGQGDSL

721 HEHIANLAGS PAIKKGILQT VKVVDELVKV MGRHKPENIV IEMARENQTT QKGQKNSRER

781 MKRIEEGIKE LGSQILKEHP VENTQLQNEK LYLYYLQNGR DMYVDQELDI NRLSDYDVDH

841 IVPQSFLKDD SIDNKVLTRS DKNRGKSDNV PSEEVVKKMK NYWRQLLNAK LITQRKFDNL

901 TKAERGGLSE LDKAGFIKRQ LVETRQITKH VAQILDSRMN TKYDENDKLI REVKVITLKS

961 KLVSDFRKDF QFYKVREINN YHHAHDAYLN AVVGTALIKK YPKLESEFVY GDYKVYDVRK

1021 MIAKSEQEIG KATAKYFFYS NIMNFFKTEI TLANGEIRKR PLIETNGETG EIVWDKGRDF

1081 ATVRKVLSMP QVNIVKKTEV QTGGFSKESI LPKRNSDKLI ARKKDWDPKK YGGFDSPTVA

1141 YSVLVVAKVE KGKSKKLKSV KELLGITIME RSSFEKNPID FLEAKGYKEV KKDLIIKLPK

1201 YSLFELENGR KRMLASAGEL QKGNELALPS KYVNFLYLAS HYEKLKGSPE DNEQKQLFVE

1261 QHKHYLDEII EQISEFSKRV ILADANLDKV LSAYNKHRDK PIREQAENII HLFTLTNLGA

1321 PAAFKYFDTT IDRKRYTSTK EVLDATLIHQ SITGLYETRI DLSQLGGD (SEQ ID NO: 5320)

17B)

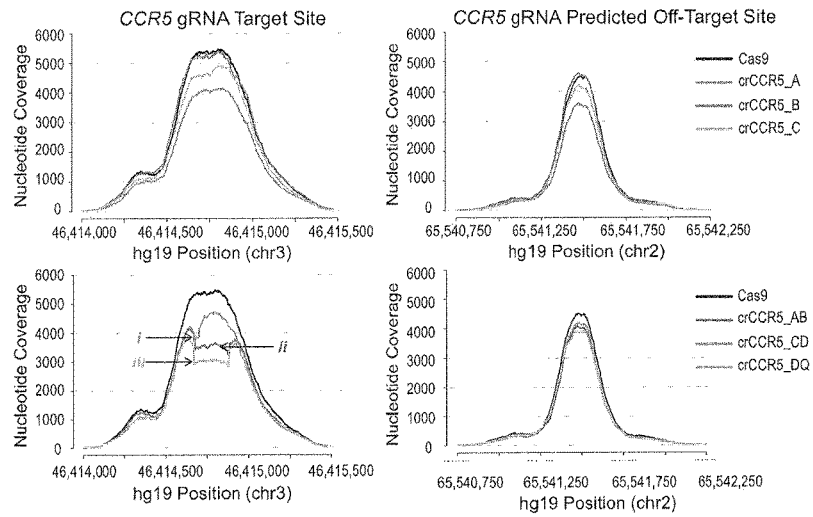

17C)

|  | crCCR5 | | | | | |
|---|---|---|---|---|---|---|
| Mutation Class | A | B | C | AB | CD | DQ |
| Predicted deletion | - | - | - | 19.95% | 20.45% | 42.13% |
| Small InDel | 5.10% | 13.54% | 13.30% | 3.06% | 0.50% | 2.95% |
| Inversion | - | - | - | 3.12% | - | 2.48% |
| Single Nucleotide Substitution | 0.03% | 0.02% | 0.00% | 0.05% | 0.15% | 0.04% |
| Others | 0.66% | 3.09% | 3.72% | 0.05% | 0.08% | 0.39% |
| Total On-Target | 5.79% | 16.65% | 17.02% | 26.23% | 21.19% | 47.99% |

17D)

| crCCR5 | Off-Target Sites | | N-Fold Enrichment of Reads with Variants (Treatment compared to Control) | | | |
|---|---|---|---|---|---|---|
|  | Total Sites | Significant Sites** | Off-Target InDel | Off-Target Other | Off-Target Combined | On-Target Combined** |
| A | 19 | 0 | 0.83 | 1.16 | 1.06 | 39.87 |
| B | 30 | 1* | 1.14* | 1.28 | 1.22 | 63 |
| C | 23 | 0 | 1.07 | 0.94 | 0.96 | 23.78 |
| D | 18 | 0 | 1.08 | 0.84 | 0.88 | 40.35 |
| Q | 36 | 0 | 0.98 | 0.78 | 0.85 | 57.66 |

```
crCCR5_A:  "GCTGCCGCCCAGTGGGACTTTGG           (SEQ ID NO: 5335)
""""""CCR2: ACTGTCTCCCTGTAGAAAACTGG           (SEQ ID NO: 5336)

crCCR5_B:  "GATCTGGTAAAGATGATTCCTGG           (SEQ ID NO: 5337)
""""""CCR2: CATTTAGTAAAGATGATTCCTGG           (SEQ ID NO: 5338)

crCCR5_C:  "ACAATGTGTCAACTCTTGACAGG           (SEQ ID NO: 5339)
""""""CCR2: GCATTTTCTGTTCTC-TGA-AGT           (SEQ ID NO: 5340)

crCCR5_D:  "TCACTATGC-TGCCGCCCAGTGG           (SEQ ID NO: 5341)
""""""CCR2: TCACTAGGCATGCTGCC-AGAGC           (SEQ ID NO: 5342)

crCCR5_Q:  "GCTGTGTTTGCGTCTCTCCAGG            (SEQ ID NO: 5343)
""""""CCR2: GCTGTGTTTGCTTGCTTCTGTCCCAGG       (SEQ ID NO: 5344)
```

18B)

| | crCCR5 treatment ||||||| |
| Mutation | B ||| AB ||| A ||
| | Reads Supporting Mutation | Total Reads at Site | Frequency | Reads Supporting Mutation | Total Reads at Site | Frequency | Reads Supporting Mutation | Total Reads at Site | Frequency |
|---|---|---|---|---|---|---|---|---|---|
| One Base Insertion | 30 | 5,963 | 0.50% | 2 | 5,339 | 0.04% | 0 | 4,678 | 0.00% |
| Two Base Insertion | 0 | 5,963 | 0.00% | 1 | 5,339 | 0.02% | 0 | 4,678 | 0.00% |
| One Base Deletion | 5 | 5,963 | 0.08% | 9 | 5,339 | 0.17% | 4 | 4,678 | 0.09% |
| Two Base Deletion | 1 | 5,963 | 0.02% | 1 | 5,339 | 0.02% | 0 | 4,678 | 0.00% |
| Total | 36 | 5,963 | 0.60% | 13 | 5,339 | 0.24% | 4 | 4,678 | 0.09% |

FIGS. 18A-18B

Table T1. Predicted gRNA mapping in Ensembl GRCh37v71

| Site | Chr | Start | End | Sequence | |
|---|---|---|---|---|---|
| guideD_OT15 | 1 | 7,721,536 | 7,721,559 | CTCCCTGGGCTGCGACCATAGTGA | SEQ ID NO. 5356 |
| guideB_OT23 | 1 | 26,857,084 | 26,857,107 | GACCTTGTGAAGATGATTCCTGG | SEQ ID NO. 5357 |
| guideB_OT17 | 1 | 40,109,230 | 40,109,253 | GATCTGGGAAAGAGGATTCCAGG | SEQ ID NO. 5358 |
| guideC_OT7 | 1 | 88,021,569 | 88,021,592 | AGATTGTGTATACTTCTTGACTAG | SEQ ID NO. 5359 |
| guideB_OT6 | 1 | 95,257,842 | 95,257,865 | CCAGGAATCATCTCTACGATATC | SEQ ID NO. 5360 |
| guideB_OT26 | 1 | 95,257,842 | 95,257,865 | CCAGGAATCATCTCTACGATATC | SEQ ID NO. 5361 |
| guideB_OT11 | 1 | 102,027,511 | 102,027,534 | CCTGGAATTCTCTTTACTAGATC | SEQ ID NO. 5362 |
| guideQ_OT35 | 1 | 109,838,856 | 109,838,879 | CCGGGAGAGGCGCGGACACAGC | SEQ ID NO. 5363 |
| guideQ_OT10 | 1 | 234,728,097 | 234,728,120 | CCAGGGAGAGACGAACCAAAAC | SEQ ID NO. 5364 |
| guideB_OT22 | 2 | 34,792,091 | 34,792,114 | GATCTGATACAGATGATTCATGG | SEQ ID NO. 5365 |
| guideB_OT2 | 2 | 55,610,332 | 55,610,355 | CTGGAATCATCTTTACAAGATG | SEQ ID NO. 5366 |
| guideD_OT4 | 2 | 65,541,463 | 65,541,486 | TGAATATCCTGTGCGCCAGTCAG | SEQ ID NO. 5367 |
| guideP_OT6 | 2 | 87,822,849 | 87,822,872 | CCACCCAAGTGATCACTCTTCCT | SEQ ID NO. 5368 |
| guideP_OT7 | 2 | 87,822,849 | 87,822,871 | AGGAAGAGTGATCACTTGGGTGG | SEQ ID NO. 5369 |
| guideQ_OT4 | 2 | 105,475,698 | 105,475,721 | TCTGTGTTTTTGTCTCTCCCCAG | SEQ ID NO. 5370 |
| guideQ_OT32 | 2 | 105,475,698 | 105,475,721 | TCTGTGTTTTTGTCTCTCCCCAG | SEQ ID NO. 5371 |
| guideP_OT7 | 2 | 112,185,053 | 112,185,076 | AGGAAGAGTGATCACTTGGGTGG | SEQ ID NO. 5372 |
| guideP_OT6 | 2 | 112,185,053 | 112,185,075 | CCACCCAAGTGATCACTCTTCCT | SEQ ID NO. 5373 |
| guideB_OT4 | 2 | 113,069,812 | 113,069,835 | CTAGGAATCATCTTCCCCAGATG | SEQ ID NO. 5374 |
| guideB_OT7 | 2 | 175,176,760 | 175,176,783 | TCTGTGGAAAAGATGATTCCAAG | SEQ ID NO. 5375 |
| guideB_OT10 | 2 | 225,356,045 | 225,356,068 | GTTCTTGTTAAGATGATTCCTGG | SEQ ID NO. 5376 |
| guideB_OT21 | 2 | 225,356,045 | 225,356,068 | GTTCTTGTTAAGATGATTCCTGG | SEQ ID NO. 5377 |
| guideP_OT3 | 2 | 239,253,476 | 239,253,499 | GGCATGTTTCATCACTTGGGGGG | SEQ ID NO. 5378 |
| guideB_OT14 | 2 | 239,332,511 | 239,332,534 | GGGCTGGTAAAGATGTTTCCAGG | SEQ ID NO. 5379 |
| guideP_OT20 | 3 | 46,399,495 | 46,399,518 | GACAAGTGTGATCACCTGGTTGG | SEQ ID NO. 5380 |
| guideQ_OT15 | 3 | 46,399,520 | 46,399,543 | GCTGTGTTTGCTTCTGTCCCAGG | SEQ ID NO. 5381 |

FIG. 20

| Name | # | Pos1 | Pos2 | Sequence | SEQ ID |
|---|---|---|---|---|---|
| guideB_OT5 | 3 | 46,399,538 | 46,399,561 | CCAGGAATCATCTTTACTAAATG | SEQ ID NO. 5382 |
| guideB_OT24 | 3 | 46,399,538 | 46,399,561 | CCAGGAATCATCTTTACTAAATG | SEQ ID NO. 5383 |
| guideD_TARGET | 3 | 46,414,654 | 46,414,677 | TCACTATGCTGCCGCCAGTGGG | SEQ ID NO. 5384 |
| guideA_TARGET | 3 | 46,414,661 | 46,414,684 | GCTGCCGCCCAGTGGGACTTTGG | SEQ ID NO. 5385 |
| guideC_TARGET | 3 | 46,414,688 | 46,414,711 | ACAATGTGTCAACTCTTGACAGG | SEQ ID NO. 5386 |
| guideP_TARGET | 3 | 46,414,834 | 46,414,857 | GACAAGTGTGATCACTTGGGTGG | SEQ ID NO. 5387 |
| guideQ_TARGET | 3 | 46,414,859 | 46,414,882 | GCTGTGTTTGCTCTCTCCCAGG | SEQ ID NO. 5388 |
| guideB_TARGET | 3 | 46,414,877 | 46,414,900 | CCAGGAATCATCTTTACCAGATC | SEQ ID NO. 5389 |
| guideC_OT6 | 3 | 51,505,036 | 51,505,059 | ACAAGGGTCAACTCTGGACAAG | SEQ ID NO. 5390 |
| guideC_OT12 | 3 | 51,505,036 | 51,505,059 | ACAAGGGGTCAACTCTGGACAAG | SEQ ID NO. 5391 |
| guideD_OT5 | 3 | 53,110,172 | 53,110,195 | CCCACTGGGCTGCAGCATCCTGG | SEQ ID NO. 5392 |
| guideQ_OT28 | 3 | 64,142,989 | 64,143,012 | CCAGCGCGTGACGCAAACACAGC | SEQ ID NO. 5393 |
| guideC_OT21 | 3 | 94,180,887 | 94,180,910 | ACAATGTGTCACCTTTTAACTGG | SEQ ID NO. 5394 |
| guideC_OT13 | 3 | 162,087,348 | 162,087,371 | ACAATATTTCAACACTTGACAAG | SEQ ID NO. 5395 |
| guideB_OT8 | 4 | 85,489,957 | 85,489,980 | CTTGGAGTCATCTTTGCCACATC | SEQ ID NO. 5396 |
| guideP_OT24 | 4 | 104,977,831 | 104,977,854 | GACAAGCGTGATCCCATGGGGAG | SEQ ID NO. 5397 |
| guideP_OT17 | 4 | 136,511,965 | 136,511,988 | CCTCCAAGTAATCACCCTTTC | SEQ ID NO. 5398 |
| guideA_OT10 | 5 | 13,378,669 | 13,378,692 | CCCAAGTCCCACTGGCAGGTGGC | SEQ ID NO. 5399 |
| guideC_OT2 | 5 | 32,668,507 | 32,668,530 | GCTATGTGTTAACTCTTGACAAG | SEQ ID NO. 5400 |
| guideC_OT11 | 5 | 32,668,507 | 32,668,530 | GCTATGTGTTAACTCTTGACAAG | SEQ ID NO. 5401 |
| guideD_OT13 | 5 | 112,310,301 | 112,310,324 | CCACTATGGTGCCTCCCAGTCAG | SEQ ID NO. 5402 |
| guideD_OT17 | 5 | 154,708,103 | 154,708,126 | TCACTCTGCTCTGTCCAGTGGG | SEQ ID NO. 5403 |
| guideD_OT1 | 5 | 157,424,997 | 157,425,020 | ACTCTGTCCTGCCGCCCAGTGAG | SEQ ID NO. 5404 |
| guideB_OT3 | 6 | 50,082,676 | 50,082,699 | CTTGGAATCATCTCTACCTGATT | SEQ ID NO. 5405 |
| guideA_OT7 | 6 | 95,560,697 | 95,560,720 | CCCAAGTCCCACTGGGTGACATG | SEQ ID NO. 5406 |
| guideQ_OT23 | 6 | 149,309,103 | 149,309,126 | CTAAGGAGAGGACCACACAGC | SEQ ID NO. 5407 |
| guideQ_OT1 | 6 | 151,120,563 | 151,120,586 | CCAGGAGGACGCAAACCCAGC | SEQ ID NO. 5408 |
| guideQ_OT24 | 6 | 151,120,563 | 151,120,586 | CCAGGAGGACGCAAACCCAGC | SEQ ID NO. 5409 |
| guideP_OT13 | 7 | 9,489,995 | 9,490,018 | CTTCTCAAGTGATCCCACTGGTC | SEQ ID NO. 5410 |

FIG. 20 cont.

| | | | | |
|---|---|---|---|---|
| guideQ_OT19 | 7 | 19,938,370 | 19,938,393 | CCTGAGAGAAGCAAACACAGA | SEQ ID NO. 5411 |
| guideQ_OT13 | 7 | 26,697,753 | 26,697,776 | CTTAGGAAAGACGCAAACATAGC | SEQ ID NO. 5412 |
| guideC_OT4 | 7 | 88,108,793 | 88,108,816 | ACATTGATTAAACTCTTGACTAG | SEQ ID NO. 5413 |
| guideC_OT9 | 7 | 120,487,950 | 120,487,973 | ACAAAGTTAAACTCTTGAGCAG | SEQ ID NO. 5414 |
| guideP_OT2 | 7 | 140,990,691 | 140,990,714 | CTTCCCAAGTGATTACACTTTAT | SEQ ID NO. 5415 |
| guideD_OT16 | 7 | 141,828,674 | 141,828,697 | CCCACTGGGCGCAGCCTAGTGA | SEQ ID NO. 5416 |
| guideC_OT8 | 7 | 145,843,581 | 145,843,604 | CTTGTCAAGATTTGCCACATTAT | SEQ ID NO. 5417 |
| guideC_OT14 | 7 | 145,843,581 | 145,843,604 | CTTGTCAAGATTTGCCACATTAT | SEQ ID NO. 5418 |
| guideQ_OT17 | 7 | 158,285,285 | 158,285,308 | CCTTGTGAGAGGCAAACACAGC | SEQ ID NO. 5419 |
| guideD_OT9 | 8 | 1,379,562 | 1,379,585 | CCTACTGGGCCTCAGCACTGTGT | SEQ ID NO. 5420 |
| guideD_OT18 | 8 | 23,095,380 | 23,095,403 | TCACTATGCAGCACCCCAGTGGG | SEQ ID NO. 5421 |
| guideB_OT28 | 8 | 104,258,547 | 104,258,570 | CCAGCCATCTCTTTACCAGCTC | SEQ ID NO. 5422 |
| guideD_OT6 | 8 | 142,638,679 | 142,638,702 | CTCACTGGGCTGCAGCATTGGGG | SEQ ID NO. 5423 |
| guideQ_OT2 | 9 | 2,427,359 | 2,427,382 | CCAGGAGAGACGCAGAAACAAC | SEQ ID NO. 5424 |
| guideQ_OT27 | 9 | 2,427,359 | 2,427,382 | CCAGGAGAGACGCAGAAACAAC | SEQ ID NO. 5425 |
| guideP_OT8 | 9 | 42,760,292 | 42,760,314 | TACATGAGTAATGATTACTCATGTA | SEQ ID NO. 5426 |
| guideP_OT9 | 9 | 42,760,292 | 42,760,314 | CTCCCAAGTGATTACTCATGTA | SEQ ID NO. 5427 |
| guideP_OT10 | 9 | 42,760,292 | 42,760,314 | CTCCCAAGTGATTACTCATGTA | SEQ ID NO. 5428 |
| guideP_OT8 | 9 | 69,769,168 | 69,769,190 | TACATGAGTAATGATTACTTGGGAG | SEQ ID NO. 5429 |
| guideP_OT9 | 9 | 69,769,168 | 69,769,190 | CTCCCAAGTGATTACTCATGTA | SEQ ID NO. 5430 |
| guideP_OT10 | 9 | 69,769,168 | 69,769,190 | CTCCCAAGTGATTACTCATGTA | SEQ ID NO. 5431 |
| guideP_OT8 | 9 | 70,135,845 | 70,135,867 | TACATGAGTAATGATTACTTGGGAG | SEQ ID NO. 5432 |
| guideP_OT9 | 9 | 70,135,845 | 70,135,867 | CTCCCAAGTGATTACTCATGTA | SEQ ID NO. 5433 |
| guideP_OT10 | 9 | 70,135,845 | 70,135,867 | CTCCCAAGTGATTACTCATGTA | SEQ ID NO. 5434 |
| guideP_OT8 | 9 | 70,386,317 | 70,386,340 | TACATGAGTAATGATTACTTGGGAG | SEQ ID NO. 5435 |
| guideP_OT9 | 9 | 70,386,317 | 70,386,339 | CTCCCAAGTGATTACTCATGTA | SEQ ID NO. 5436 |
| guideP_OT10 | 9 | 70,386,317 | 70,386,339 | CTCCCAAGTGATTACTCATGTA | SEQ ID NO. 5437 |
| guideP_OT1 | 9 | 80,982,901 | 80,982,924 | CAGAGGTGTGATCACTTGGGCAG | SEQ ID NO. 5438 |
| guideP_OT21 | 9 | 80,982,901 | 80,982,924 | CAGAGGTGTGATCACTTGGGCAG | SEQ ID NO. 5439 |

FIG. 20 cont.

| | | | | | |
|---|---|---|---|---|---|
| guideP_OT5 | 9 | 117,954,855 | 117,954,878 | CTTCCCATGTGATAACACTTGTC | SEQ ID NO. 5440 |
| guideP_OT11 | 9 | 117,954,855 | 117,954,878 | CTTCCCATGTGATAACACTTGTC | SEQ ID NO. 5441 |
| guideQ_OT20 | 10 | 3,031,086 | 3,031,109 | CCTGAGAGAGGCAAACACATC | SEQ ID NO. 5442 |
| guideB_OT19 | 10 | 20,040,235 | 20,040,258 | CCACGAATCCTCTTTACCAAATC | SEQ ID NO. 5443 |
| guideP_OT9 | 10 | 42,689,588 | 42,689,611 | CTCCCAAGTGATTACTCATGTA | SEQ ID NO. 5444 |
| guideP_OT8 | 10 | 42,689,588 | 42,689,610 | TACATGAGTAATCACTTGGGAG | SEQ ID NO. 5445 |
| guideP_OT10 | 10 | 42,689,588 | 42,689,610 | CTCCCAAGTGATTACTCATGTA | SEQ ID NO. 5446 |
| guideQ_OT9 | 10 | 47,655,769 | 47,655,792 | CCTGAGGGTGCCTCTCTCCCGGG | SEQ ID NO. 5447 |
| guideQ_OT7 | 10 | 77,358,062 | 77,358,085 | GCTGTGTGCTCGTCTCTCCCTGG | SEQ ID NO. 5448 |
| guideQ_OT31 | 10 | 77,358,062 | 77,358,085 | GCTGTGTGCTGCTCTCTCCCTGG | SEQ ID NO. 5449 |
| guideA_OT15 | 10 | 88,295,312 | 88,295,335 | GCGGCCCAGCGGGACCTGGG | SEQ ID NO. 5450 |
| guideQ_OT34 | 10 | 98,895,438 | 98,895,461 | GCTGTACTTGGGTCTCTCCCCAG | SEQ ID NO. 5451 |
| guideQ_OT8 | 10 | 117,958,114 | 117,958,137 | GCCGTGTTTTCCTCTCTCCCAAG | SEQ ID NO. 5452 |
| guideQ_OT11 | 10 | 117,958,114 | 117,958,137 | GCCGTGTTTTCCTCTCTCCCAAG | SEQ ID NO. 5453 |
| guideD_OT7 | 10 | 129,722,982 | 129,723,005 | CCCACTGGGCTGCAGAATACAGA | SEQ ID NO. 5454 |
| guideP_OT25 | 10 | 131,328,679 | 131,328,702 | CCCCCAGGAGACATCACATTTGTC | SEQ ID NO. 5455 |
| guideA_OT16 | 11 | 2,952,375 | 2,952,398 | GCTGCCGGACAGTGGGACCTGGG | SEQ ID NO. 5456 |
| guideD_OT14 | 11 | 36,441,686 | 36,441,709 | CTGACTGGACCGCACCTTAGTGA | SEQ ID NO. 5457 |
| guideQ_OT25 | 11 | 45,632,027 | 45,632,050 | GCTGTCTTTTCCTCTCTCCCTGG | SEQ ID NO. 5458 |
| guideB_OT25 | 11 | 58,575,305 | 58,575,328 | CCAGAAATAATCTTTACCAGCTC | SEQ ID NO. 5459 |
| guideQ_OT22 | 11 | 62,783,309 | 62,783,332 | GCTGTGTTGTGTCCCTCCCCAGG | SEQ ID NO. 5460 |
| guideC_OT10 | 11 | 77,709,742 | 77,709,765 | ACAAATGTGTTGGCTCTTGACTAG | SEQ ID NO. 5461 |
| guideC_OT19 | 11 | 77,709,742 | 77,709,765 | ACAATGTGTTGGCTCTTGACTAG | SEQ ID NO. 5462 |
| guideP_OT26 | 11 | 115,496,055 | 115,496,078 | GACAAGTCTGATCATTTTGGGG | SEQ ID NO. 5463 |
| guideQ_OT26 | 12 | 4,379,332 | 4,379,355 | CCACGGAGAAACACAAACACAGC | SEQ ID NO. 5464 |
| guideC_OT1 | 12 | 12,976,312 | 12,976,335 | AAAATGTGTCAACTCTTGATTAG | SEQ ID NO. 5465 |
| guideC_OT16 | 12 | 12,976,312 | 12,976,335 | AAAATGTGTCAACTCTTGATTAG | SEQ ID NO. 5466 |
| guideQ_OT21 | 12 | 19,270,661 | 19,270,684 | TCTGTGTTTGCCTCTCTCTCAGG | SEQ ID NO. 5467 |
| guideC_OT18 | 12 | 53,711,726 | 53,711,749 | ACAATGTGCCAGCTCTGACTAG | SEQ ID NO. 5468 |

FIG. 20 cont.

| | | | | |
|---|---|---|---|---|
| guideP_OT12 | 12 | 81,881,220 | 81,881,243 | GACAAGTATCAGCACTTGGTAAG | SEQ ID NO. 5469 |
| guideP_OT14 | 12 | 94,428,361 | 94,428,384 | GACTAGTGTGTTCTCTTGGAAG | SEQ ID NO. 5470 |
| guideP_OT4 | 12 | 98,582,748 | 98,582,771 | GACATGTGTAAACACTTGGAAG | SEQ ID NO. 5471 |
| guideP_OT16 | 12 | 98,582,748 | 98,582,771 | GACATGTGTAAACACTTGGAAG | SEQ ID NO. 5472 |
| guideA_OT3 | 12 | 108,460,819 | 108,460,842 | CCAAAGTCCCACTGGGTGACATC | SEQ ID NO. 5473 |
| guideA_OT13 | 12 | 108,460,819 | 108,460,842 | CCAAAGTCCCACTGGGTGACATC | SEQ ID NO. 5474 |
| guideQ_OT18 | 13 | 20,693,503 | 20,693,526 | CCTGTGAGAGGCTCAAACACAGC | SEQ ID NO. 5475 |
| guideA_OT9 | 13 | 21,047,396 | 21,047,419 | CCGCAGTCCCACTGTGCGGCACC | SEQ ID NO. 5476 |
| guideA_OT14 | 13 | 21,047,396 | 21,047,419 | CCGCAGTCCCACTGTGCGGCACC | SEQ ID NO. 5477 |
| guideP_OT22 | 13 | 25,242,593 | 25,242,616 | GACAAGTGTGTTCACTTCTGCAG | SEQ ID NO. 5478 |
| guideB_OT15 | 13 | 42,388,792 | 42,388,815 | GATTTGGGAAAGATCATTCCAGG | SEQ ID NO. 5479 |
| guideB_OT9 | 13 | 69,477,970 | 69,477,993 | GCTTTGGTAAAGTTGATTCCTAG | SEQ ID NO. 5480 |
| guideC_OT5 | 13 | 94,575,221 | 94,575,244 | AAACTGTGATAACTCTTGACTGG | SEQ ID NO. 5481 |
| guideA_OT6 | 14 | 56,740,798 | 56,740,821 | CCTAAGTCCCACTGGCCGAAAGT | SEQ ID NO. 5482 |
| guideB_OT20 | 14 | 73,729,934 | 73,729,957 | GTTCTGGTCAAGATGACTCCTGG | SEQ ID NO. 5483 |
| guideA_OT17 | 14 | 76,844,953 | 76,844,976 | CCCAGGACCCACTGGGCCAGCAGC | SEQ ID NO. 5484 |
| guideC_OT3 | 14 | 98,955,845 | 98,955,868 | AAAATCTGTCAACTCTTGAATAG | SEQ ID NO. 5485 |
| guideC_OT17 | 14 | 98,955,845 | 98,955,868 | AAAATCTGTCAACTCTTGAATAG | SEQ ID NO. 5486 |
| guideC_OT23 | 14 | 103,419,411 | 103,419,434 | CTCATTCAGGAGTGGACACATTGT | SEQ ID NO. 5487 |
| guideQ_OT30 | 14 | 105,212,041 | 105,212,064 | CCAGGGGACACGCAAACACTGC | SEQ ID NO. 5488 |
| guideD_OT11 | 15 | 27,937,804 | 27,937,827 | TCACTTGTGCTGCCAGCCAGTTGG | SEQ ID NO. 5489 |
| guideA_OT8 | 15 | 28,812,084 | 28,812,107 | CTGAAGTCCCACTACTGGGTGGTGT | SEQ ID NO. 5490 |
| guideA_OT4 | 15 | 30,815,609 | 30,815,631 | GCACCAGCCCAGTGGGACTTCAG | SEQ ID NO. 5491 |
| guideA_OT5 | 15 | 30,815,609 | 30,815,631 | GCACCAGCCCAGTGGGACTTCAG | SEQ ID NO. 5492 |
| guideA_OT4 | 15 | 32,776,439 | 32,776,462 | GCACCAGCCCAGTGGGACTTCAG | SEQ ID NO. 5493 |
| guideA_OT5 | 15 | 32,776,439 | 32,776,462 | GCACCAGCCCAGTGGGACTTCAG | SEQ ID NO. 5494 |
| guideQ_OT29 | 15 | 58,817,723 | 58,817,746 | CCAGGAAAGAGGCAAGCACAGC | SEQ ID NO. 5495 |
| guideD_OT3 | 16 | 17,377,804 | 17,377,827 | CCACTATACACCGCCCAGTCAG | SEQ ID NO. 5496 |
| guideD_OT10 | 16 | 34,381,274 | 34,381,297 | CCATTGTGCTGCCGCCCAGCCAG | SEQ ID NO. 5497 |

FIG. 20 cont.

| | | | | | |
|---|---|---|---|---|---|
| guideB_OT1 | 16 | 66,123,576 | 66,123,599 | GATCTGGAAGAGATGATTCCAAG | SEQ ID NO. 5498 |
| guideQ_OT36 | 17 | 11,833,418 | 11,833,441 | CCCGGGAGGCAGGCAAAAACAGC | SEQ ID NO. 5499 |
| guideQ_OT6 | 17 | 18,078,932 | 18,078,955 | GCTCAGTCTGGGTCTCTCCCCAG | SEQ ID NO. 5500 |
| guideQ_OT33 | 17 | 18,078,932 | 18,078,955 | GCTGAGTCTGGGTCTCTCCCCAG | SEQ ID NO. 5501 |
| guideB_OT12 | 17 | 21,284,881 | 21,284,903 | CCTGGAATGTTCTTTCCCAGATC | SEQ ID NO. 5502 |
| guideB_OT13 | 17 | 21,284,881 | 21,284,903 | CCTGGAATGTTCTTTCCCAGATC | SEQ ID NO. 5503 |
| guideP_OT23 | 17 | 59,879,562 | 59,879,585 | GACAGGTGTGAGCACTTTGGAG | SEQ ID NO. 5504 |
| guideP_OT18 | 17 | 65,415,053 | 65,415,076 | GACACTTGTGATGACTTGGGTAG | SEQ ID NO. 5505 |
| guideQ_OT5 | 18 | 11,204,603 | 11,204,626 | CTTTGGAGAGACCGCAGACACTGC | SEQ ID NO. 5506 |
| guideQ_OT12 | 18 | 11,204,603 | 11,204,626 | CTTTGGAGAGACCGCAGACACTGC | SEQ ID NO. 5507 |
| guideB_OT12 | 18 | 12,705,728 | 12,705,751 | CCTGGAATGTTCTTTCCCAGATC | SEQ ID NO. 5508 |
| guideB_OT13 | 18 | 12,705,728 | 12,705,751 | CCTGGAATGTTCTTTCCCAGATC | SEQ ID NO. 5509 |
| guideP_OT19 | 18 | 41,187,999 | 41,188,022 | CTACCCAAGTGTTCATATTTGTC | SEQ ID NO. 5510 |
| guideB_OT27 | 18 | 69,924,495 | 69,924,518 | CCAGAAATCATGTTTACCAGCTC | SEQ ID NO. 5511 |
| guideA_OT2 | 19 | 35,800,794 | 35,800,817 | CTGAGTCCCACTGCGCGGCAGC | SEQ ID NO. 5512 |
| guideQ_OT14 | 20 | 23,302,200 | 23,302,223 | CCTGGGAAAGGCGCAAACACAGC | SEQ ID NO. 5513 |
| guideB_OT18 | 20 | 23,472,840 | 23,472,863 | GATCTGATAAAGTGAGTCCAGG | SEQ ID NO. 5514 |
| guideD_OT2 | 20 | 37,102,053 | 37,102,076 | GCAGTTGCTGCCGCCAGTGGG | SEQ ID NO. 5515 |
| guideP_OT8 | 21 | 9,588,789 | 9,588,811 | TACATGAGTAATCACTTGGGAG | SEQ ID NO. 5516 |
| guideP_OT9 | 21 | 9,588,789 | 9,588,811 | CTCCCCAAGTGATTACTCATGTA | SEQ ID NO. 5517 |
| guideP_OT10 | 21 | 9,588,789 | 9,588,811 | CTCCCCAAGTGATTACTCATGTA | SEQ ID NO. 5518 |
| guideQ_OT3 | 21 | 32,760,114 | 32,760,137 | GCAGTGTGTGGGTCTCTCCCAGG | SEQ ID NO. 5519 |
| guideQ_OT16 | 21 | 32,760,114 | 32,760,137 | GCAGTGTGTGGGTCTCTCCCAGG | SEQ ID NO. 5520 |
| guideP_OT8 | 22 | 17,376,827 | 17,376,849 | TACATGAGTAATCACTTGGGAG | SEQ ID NO. 5521 |
| guideP_OT9 | 22 | 17,376,827 | 17,376,849 | CTCCCCAAGTGATTACTCATGTA | SEQ ID NO. 5522 |
| guideP_OT10 | 22 | 17,376,827 | 17,376,849 | CTCCCCAAGTGATTACTCATGTA | SEQ ID NO. 5523 |
| guideA_OT12 | 22 | 30,136,704 | 30,136,727 | CCAAAGTCGCACTGGCCTGCAGC | SEQ ID NO. 5524 |
| guideB_OT16 | 22 | 45,907,886 | 45,907,909 | GATCTGGGAGAGAAGATTCCAGG | SEQ ID NO. 5525 |
| guideC_OT20 | X | 6,258,801 | 6,258,824 | CCAGAAAAGAGTTGACACATAGT | SEQ ID NO. 5526 |

FIG. 20 cont.

| | | | | |
|---|---|---|---|---|
| guideC_OT15 | | 21,926,730 | 21,926,753 | CCTGCCAAGGGTTGACACATGGT | SEQ ID NO. 5527 |
| guideP_OT15 | X | 32,405,319 | 32,405,342 | GACAAGTGTCATAACTTTGGAAG | SEQ ID NO. 5528 |
| guideC_OT22 | X | 64,736,013 | 64,736,036 | ATAATGTGTCAACCCTGGACCAG | SEQ ID NO. 5529 |
| guideA_OT1 | X | 70,836,963 | 70,836,986 | CCAAAGACCCACTGGACGGCAGC | SEQ ID NO. 5530 |
| guideA_OT11 | X | 70,836,963 | 70,836,986 | CCAAAGACCCACTGGACGGCAGC | SEQ ID NO. 5531 |
| guideD_OT8 | X | 106,847,189 | 106,847,212 | CCAACTGGCCGGCAGCCTGGTGA | SEQ ID NO. 5532 |
| guideD_OT12 | X | 106,847,189 | 106,847,212 | CCAACTGGCCGGCAGCCTGGTGA | SEQ ID NO. 5533 |

FIG. 20 cont.

Table T2. Guide Pair crCCR5_A+B On-Target Alleles

| Allele | Cas9 Guide Site | Sequence | Split Reads (+) Strand | Split Reads (-) Strand | Split Reads TOTAL | Estimated Allele Frequency |
|---|---|---|---|---|---|---|
| Reference | A (Distal) | TATGCTGCCCGCCCAGTGGGACTTTGGAAATACAATGTGTCAACTC | 1836 | 1728 | 3564 | 76.78% (SEQ ID NO. 5534) |
| Reference | B (Proximal) | GGCTGTGTTTGCGTCTCTCCCAGGAATCATCTTTACCAGATCTCA | 1340 | 1753 | 3093 | 73.80% (SEQ ID NO. 5535) |
| 206bp deletion | AB (Both) | TATGCTGCCCGCCCAGTGGGA \| ATCATCTTTACCAGATCTCAAAAAG | 411 | 411 | 822 | 18.61% (SEQ ID NOS. 5536, 5537) |
| 205bp inversion | AB (Both) | GAGTTGACACATTGTATTTCCAAAG \| ATCATCTTTACCAGATCTCA | 60 | 78 | 138 | 3.12% (SEQ ID NOS. 5538, 5539) (SEQ ID NOS. 5540, 5541) |
| | | TATGCTGCCCGCCCAGTGGGA \| TCCTGGGAGAGACCGAAACACAGCC | | | | |
| 1bp deletion | B (Proximal) | TGGCTGTGTTTGCGTCTCTCCCAGG \| ATCATCTTTACCAGATCTCA | 23 | 27 | 50 | 1.19% (SEQ ID NOS. 5542, 5543) |
| 206bp deletion with C insertion at break | AB (Both) | TATGCTGCCCGCCCAGTGGGA \| CATCATCTTTACCAGATCTCAAAAA | 19 | 8 | 27 | 0.61% (SEQ ID NOS. 5544, 5545) |
| 1bp deletion | A (Distal) | TATGCTGCCCGCCCAGTGGGA \| TTTGGAAATACAATGTGTCAACTCT | 14 | 11 | 25 | 0.54% (SEQ ID NOS. 5546, 5547) |
| 207bp deletion | AB (Both) | TATGCTGCCCGCCCAGTGGGA \| TCATCTTTACCAGATCTCAAAAGA | 10 | 8 | 18 | 0.41% (SEQ ID NOS. 5548, 5549) |
| A insertion | B (Proximal) | GCTGTGTTTGCGTCTCTCCCAGGAA \| ATCATCTTTACCAGATCTCA | 7 | 8 | 15 | 0.36% (SEQ ID NOS. 5550, 5551) |
| A insertion | A (Distal) | TATGCTGCCCGCCCAGTGGGA \| ACTTTGAAAATACAATGTGTCAACT | 4 | 7 | 11 | 0.24% (SEQ ID NOS. 5552, 5553) |
| 3bp deletion | A (Distal) | TATGCTGCCCGCCCAGTGGGA \| TGGAAAATACAATGTGTCAACTCTTG | 7 | 0 | 7 | 0.15% (SEQ ID NOS. 5554, 5555) |
| 2bp deletion | B (Proximal) | GTGCTGTGTTTGCGTCTCTCCCAG \| ATCATCTTTACCAGATCTCA | 4 | 2 | 6 | 0.14% (SEQ ID NOS. 5556, 5557) |
| TC insertion | A (Distal) | TATGCTGCCCGCCCAGTGGGA \| TCCTTTGGAAATACAATGTGTCAAC | 3 | 3 | 6 | 0.13% (SEQ ID NOS. 5558, 5559) |
| 209bp deletion | AB (Both) | TATGCTGCCCGCCCAGTGGGA \| ATCTTTACCAGATCTCAAAAGAAG | 1 | 4 | 5 | 0.11% (SEQ ID NOS. 5560, 5561) |
| 4bp deletion | B (Proximal) | TGGTGGCTGTGTTTGCGTCTCTCCC \| ATCATCTTTACCAGATCTCA | 4 | 0 | 4 | 0.10% (SEQ ID NOS. 5562, 5563) |
| 205bp deletion | AB (Both) | TATGCTGCCCGCCCAGTGGGA \| AATCATCTTTACCAGATCTCAAAAA | 2 | 2 | 4 | 0.09% (SEQ ID NOS. 5564, 5565) |
| 206bp deletion with A insertion at break | AB (Both) | TCACTATGCTGCCCGCCCAGTGGGAA \| ATCATCTTTACCAGATCTCA | 2 | 2 | 4 | 0.09% (SEQ ID NOS. 5566, 5567) |
| 12bp deletion | A (Distal) | TATGCTGCCCGCCCAGTGGGA \| AATGTGTCAACTCTTGACAGGGCTC | 4 | 0 | 4 | 0.09% (SEQ ID NOS. 5568, 5569) |
| 2bp deletion | A (Distal) | TATGCTGCCCGCCCAGTGGGA \| TTGGAAATACAATGTGTCAACTCTT | 2 | 1 | 3 | 0.06% (SEQ ID NOS. 5570, 5571) |

FIG. 21

| | | | | | |
|---|---|---|---|---|---|
| Unidentifiable novel sequence insertion | B (Proximal) | GAGTTACATGATCCCCATCTTGTG \| ATCATCTTTACCAGATCTCA | 2 | 2 | 0.05% (SEQ ID NOS. 5572, 5573) |
| 5bp deletion | B (Proximal) | GTGGTGGCTGTGTTGCGTCTCCCC \| ATCATCTTTACCAGATCTCA | 1 | 1 | 0.02% (SEQ ID NOS. 5574, 5575) |
| A->T transversion | B (Proximal) | GGCTGTGTTTGCGTCTCTCCCAGGTATCATCTTTACCAGATCTCA | 0 | 1 | 0.02% (SEQ ID NOS. 5576) |
| 208bp deletion | AB (Both) | TATGCTGCCGCCCAGTGGGA \| CATCTTTACCAGATCTCAAAAAGAA | 1 | 1 | 0.02% (SEQ ID NOS. 5577, 5578) |
| 7bp deletion | A (Distal) | TATGCTGCCGCCCAGTGGGA \| AATACAATGTGTCAACTCTTGACAG | 0 | 1 | 0.02% (SEQ ID NOS. 5579, 5580) |
| 8bp deletion | A (Distal) | TATGCTGCCGCCCAGTGGGA \| ATACAATGTGTCAACTCTTGACAGG | 0 | 1 | 0.02% (SEQ ID NOS. 5581, 5582) |
| C->T transition | A (Distal) | TATGCTGCCGCCAGTGGGATTTTGGAAATACAATGTTTCAACTC | 1 | 1 | 0.02% (SEQ ID NOS. 5583) |

FIG. 21 cont.

Table T3. Guide Pair crCCR5_C+D On-Target Alleles

| Allele | Cas9 Guide Site | Sequence | Split Reads | | | Estimated Allele Frequency |
|---|---|---|---|---|---|---|
| | | | (+) Strand | (-) Strand | TOTAL | |
| Reference | C (Proximal) | ATACAATGTGTCAACTCTTGACAGGGCTCTATTTATAGGCTTCT | 1704 | 1457 | 3161 | 79.72% (SEQ ID NO. 5584) |
| Reference | D (Distal) | GGCTCACTATGCTGCCCGCCCAGTGGGACTTTGGAAATACAATGTG | 1659 | 1459 | 3118 | 78.64% (SEQ ID NO. 5585) |
| 35bp deletion | CD (Both) | GGCTCACTATGCTGCCGCCCC \| GACAGGGCTCTATTTATAGGCTTC | 310 | 270 | 580 | 14.63% (SEQ ID NO. 5586, 5587) |
| 34bp deletion | CD (Both) | GGCTCACTATGCTGCCGCCC \| TGACAGGGCTCTATTTATAGGCTT | 97 | 99 | 196 | 4.94% (SEQ ID NO. 5588, 5589) |
| 33bp deletion | CD (Both) | GGCTCACTATGCTGCCGCCC \| TTGACAGGGCTCTATTTATAGGCT | 23 | 11 | 34 | 0.86% (SEQ ID NO. 5590, 5591) |
| 1bp deletion | C (Proximal) | AATACAATGTGTCAACTCT \| GACAGGGCTCTATTTATAGGCTTCT | 6 | 3 | 9 | 0.23% (SEQ ID NO. 5592, 5593) |
| T->G transversion 1bp 5' of PAM | D (Distal) | GGCTCACTATGCTGCCGCCCAGGGGACTTTGGAAATACAATGTG | 3 | 0 | 3 | 0.08% (SEQ ID NO. 5594) |
| 3bp deletion | D (Distal) | GGCTCACTATGCTGCCGCCC \| GGGACTTTGGAAATACAATGTCA | 3 | 0 | 3 | 0.08% (SEQ ID NO. 5595, 5596) |
| Unidentifiable novel sequence insertion | C (Proximal) | CCGGCAAACAAACCACCGC \| GACAGGGCTCTATTTATAGGCTTCT | 3 | 0 | 3 | 0.08% (SEQ ID NO. 5597, 5598) |
| 3bp deletion | C (Proximal) | GAAATACAATGTGTCAACT \| GACAGGGCTCTATTTATAGGCTTCT | 3 | 0 | 3 | 0.08% (SEQ ID NO. 5599, 5600) |
| 5bp deletion | C (Proximal) | TCACTATACAATGTGTCAAGAC \| AGGGCTCTATTTATAGGCTTCT | 2 | 0 | 2 | 0.05% (SEQ ID NO. 5601, 5602) |
| 2bp deletion | C (Proximal) | AAATACAATGTGTCAACTC \| GACAGGGCTCTATTTATAGGCTTCT | 0 | 2 | 2 | 0.05% (SEQ ID NO. 5603, 5604) |
| 34bp deletion; breaks offset 1bp 3' of both Cas9 sites | CD (Both) | GGCTCACTATGCTGCCGCCC \| AACAGGGCTCTATTTATAGGCTTC | 1 | 0 | 1 | 0.03% (SEQ ID NO. 5605, 5606) |
| G->A transition middle base of PAM | C (Proximal) | ATACAATGTGTCAACTCTTGACAGAGCCTCTATTTATAGGCTTCT | 1 | 0 | 1 | 0.03% (SEQ ID NO. 5607) |
| 19bp deletion | C (Proximal) | CCCAGTGGGACTTTGGAAAA \| ACAGGGCTCTATTTATAGGCTTCT | 1 | 0 | 1 | 0.03% (SEQ ID NO. 5608, 5609) |
| T->C transition 2bp 5' of Cas9 site | C (Proximal) | ATACAATGTGTCAACTCCT \| GACAGGGCTCTATTTATAGGCTTCT | 1 | 0 | 1 | 0.03% (SEQ ID NO. 5610, 5611) |
| T->C transition | C (Proximal) | ATACAATGTGTCAACTCTC \| GACAGGGCTCTATTTATAGGCTTCT | 0 | 1 | 1 | 0.03% (SEQ ID NO. 5612, 5613) |

FIG. 22

Table T4. Guide Pair crCCR5_D+Q On-Target Alleles

| Allele | Cas9 Guide Site | Sequence | Split Reads (+) Strand | Split Reads (-) Strand | Split Reads TOTAL | Estimated Allele Frequency |
|---|---|---|---|---|---|---|
| Reference | D (Distal) | GGCTCACTATGCTGCGCCCAGTGGGACTTTGGAAATACAATGTG | 1662 | 1261 | 2923 | 54.53% (SEQ ID NO. 5614) |
| Reference | Q (Proximal) | GGGTGGTGGCTGTGTTTGCGTTCTCCCAGGAATCATCTTTACCA | 1296 | 1535 | 2831 | 52.82% (SEQ ID NO. 5615) |
| 205bp deletion | DQ (Both) | TTCTGGGCTCACTATGCTGCCGCCC \| CCCAGGAATCATCTTTACCA | 332 | 269 | 601 | 11.21% (SEQ ID NO. 5616, 5617) |
| 205bp deletion | DQ (Both) | GGCTCACTATGCTGCCGCCC \| CCCAGGAATCATCTTACCAGATCT | 321 | 248 | 569 | 10.62% (SEQ ID NO. 5618, 5619) |
| 204bp deletion | DQ (Both) | GGCTCACTATGCTGCCGCCC \| TCCCAGGAATCATCTTACCAGATC | 235 | 278 | 513 | 9.57% (SEQ ID NO. 5620, 5621) |
| 204bp deletion | DQ (Both) | TCTGGGCTCACTATGCTGCCGCCT \| CCCAGGAATCATCTTTACCA | 223 | 273 | 496 | 9.25% (SEQ ID NO. 5622, 5623) |
| 205bp inversion | DQ (Both) | GGCTCACTATGCTGCCGCCC \| AGAGACGCAAACACAGCCACCACC | 48 | 41 | 89 | 1.66% (SEQ ID NO. 5624, 5625) |
| 19bp deletion | D (Distal) | CACATTGTATTTCCAAAGTCCCACT \| CCCAGGAATCATCTTTACCA | | | | (SEQ ID NO. 5626, 5627) |
| 206bp inversion | DQ (Both) | GGCTCACTATGCTGCCGCCC \| AATGTGTCAACTCTTGACAGGCTC | 41 | 24 | 65 | 1.21% (SEQ ID NO. 5628, 5629) |
| | | GGCTCACTATGCTGCCGCCC \| AGAGACGCAAACAGCCACCACCC | | | | (SEQ ID NO. 5630, 5631) |
| 206bp inversion | DQ (Both) | ACATTGTATTTCCAAAGTCCCACTT \| CCCAGGAATCATCTTTACCA | 26 | 18 | 44 | 0.82% (SEQ ID NO. 5632, 5633) |
| T insertion | D (Distal) | GGCTCACTATGCTGCCGCCC \| TAGTGGGACTTTGGAAATACAATGT | 8 | 9 | 17 | 0.32% (SEQ ID NO. 5634, 5635) |
| T insertion | Q (Proximal) | GGTGGTGGCTGTGTTTGCGTCTCTT \| CCCAGGAATCATCTTTACCA | 7 | 8 | 15 | 0.28% (SEQ ID NO. 5636, 5637) |
| 206bp deletion | DQ (Both) | CTTCTGGGCTCACTATGCTGCCGCC \| CCCAGGAATCATCTTTACCA | 4 | 9 | 13 | 0.24% (SEQ ID NO. 5638, 5639) |
| Unidentifiable novel sequence insertion | Q (Proximal) | GCTGTTTCCTGCTGTGTGAATTGTTAT \| CCCAGGAATCATCTTTACCA | 5 | 7 | 12 | 0.22% (SEQ ID NO. 5640, 5641) |
| 208bp deletion | DQ (Both) | CCCTTCTGGGCTCACTATGCTGCCG \| CCCAGGAATCATCTTTACCA | 4 | 6 | 10 | 0.19% (SEQ ID NO. 5642, 5643) |
| 208bp deletion | DQ (Both) | GGCTCACTATGCTGCCGCCC \| AGGAATCATCTTACCAGATCTTCAA | 4 | 5 | 9 | 0.17% (SEQ ID NO. 5644, 5645) |
| 207bp deletion | DQ (Both) | GGCTCACTATGCTGCCGCCC \| CCAAGGAATCATCTTTACCAGATCTC | 2 | 7 | 9 | 0.17% (SEQ ID NO. 5646, 5647) |
| 109bp deletion w/ TTA insertion | D (Distal) | GGCTCACTATGCTGCCGCCC \| TTACTGTCCTCCATGCTGTGTTTGC | 5 | 3 | 8 | 0.15% (SEQ ID NO. 5648, 5649) |
| 205bp deletion | DQ (Both) | TTCTGGGCTCACTATGCTGCCGCCC \| TCCCAGGAATCATCTTTACCA | 4 | 3 | 7 | 0.13% (SEQ ID NO. 5650, 5651) |
| 219bp deletion | DQ (Both) | GGCTCACTATGCTGCCGCCC \| TTACCAGATCTCAAAAAGAAGGTCT | 3 | 4 | 7 | 0.13% (SEQ ID NO. 5652, 5653) |
| Unidentifiable novel sequence insertion | D (Distal) | GGCTCACTATGCTGCCGCCC \| TGTATACCGTCGACCTCTAGCTAGA | 3 | 3 | 6 | 0.11% (SEQ ID NO. 5654, 5655) |
| C insertion | D (Distal) | GGCTCACTATGCTGCCGCCC \| CAGTGGGACTTTGGAAATACAATGT | 2 | 3 | 5 | 0.09% (SEQ ID NO. 5656, 5657) |
| 2bp deletion | D (Distal) | GGCTCACTATGCTGCCGCCC \| TGGGACTTTGGAAACACAATGTC | 2 | 3 | 5 | 0.09% (SEQ ID NO. 5658, 5659) |
| 14bp deletion | D (Distal) | GGCTCACTATGCTGCCGCCC \| AATACAATGTGTCAACTCTTGACAG | 0 | 5 | 5 | 0.09% (SEQ ID NO. 5660, 5661) |
| 202bp deletion | DQ (Both) | GGCTCACTATGCTGCCGCCC \| TCTCCCAGGAATCATCTTTACCAG | 0 | 5 | 5 | 0.09% (SEQ ID NO. 5662, 5663) |
| 202bp deletion | DQ (Both) | TGGGCTCACTATGCTGCGGCCCT \| CCCAGGAATCATCTTTACCA | 0 | 5 | 5 | 0.09% (SEQ ID NO. 5664, 5665) |
| 215bp deletion | DQ (Both) | TACTGTCCCCTTCTGGGCTCACTAT \| CCCAGGAATCATCTTTACCA | 2 | 2 | 4 | 0.07% (SEQ ID NO. 5666, 5667) |

FIG. 23

| Mutation | Guide | Sequence | | | Count1 | Count2 | Count3 | Frequency |
|---|---|---|---|---|---|---|---|---|
| 1bp deletion | Q (Proximal) | TGGGTGGTGGCTGTGTGTTTGCGTCTT | ; | CCCAGGAATCATCTTTACCA | 2 | 2 | 4 | 0.07% (SEQ ID NO. 5668, 5669) |
| 4bp deletion | Q (Proximal) | ACTTGGGTGGTGGCTGTGTTTGCGT | ; | CCCAGGAATCATCTTTACCA | 1 | 3 | 4 | 0.07% (SEQ ID NO. 5670, 5671) |
| A insertion | D (Distal) | GGCTCACTATGCTGCCGCCC | ; | AAGTGGGACTTTGGAAATACAATGT | 3 | 0 | 3 | 0.06% (SEQ ID NO. 5672, 5673) |
| 1bp deletion | D (Distal) | GGCTCACTATGCTGCCGCCC | ; | GTGGGACTTTGGAAATACAATGTGT | 3 | 0 | 3 | 0.06% (SEQ ID NO. 5674, 5675) |
| 72bp deletion | D (Distal) | GGCTCACTATGCTGCCGCCC | ; | TCTTCATCATCCTCCTGACAATCGA | 3 | 0 | 3 | 0.06% (SEQ ID NO. 5676, 5677) |
| 48bp deletion | D (Distal) | GGCTCACTATGCTGCCGCCC | ; | TTATAGGCTTCTTCTCTGGAATCTT | 3 | 0 | 3 | 0.06% (SEQ ID NO. 5678, 5679) |
| Unidentifiable novel sequence insertion | Q (Proximal) | TTCTTCGATCAGTCTAAAAATGGCT | ; | CCCAGGAATCATCTTTACCA | 3 | 0 | 3 | 0.06% (SEQ ID NO. 5680, 5681) |
| 214bp deletion | DQ (Both) | GGCTCACTATGCTGCCGCCC | ; | CATCTTTACCAGATCTCAAAAGAA | 2 | 1 | 3 | 0.06% (SEQ ID NO. 5682, 5683) |
| 50bp deletion | D (Distal) | GGCTCACTATGCTGCCGCCC | ; | AATAGGCTTCTTCTTCTGGAATCTTC | 0 | 3 | 3 | 0.06% (SEQ ID NO. 5684, 5685) |
| 152bp deletion | D (Distal) | GGCTCACTATGCTGCCGCCC | ; | TTTGGGGTGGTGACAAGTGTGATCA | 0 | 3 | 3 | 0.06% (SEQ ID NO. 5686, 5687) |
| 181bp deletion | DQ (Both) | GGCTCACTATGCTGCCGCCC | ; | TTAAAAGCAGGACGGTCACCTTTG | 0 | 3 | 3 | 0.06% (SEQ ID NO. 5688, 5689) |
| 192bp deletion | DQ (Both) | GGCTCACTATGCTGCCGCCC | ; | TGTTTGCCTCTCCCAGGAATCAT | 1 | 1 | 2 | 0.04% (SEQ ID NO. 5690, 5691) |
| 13bp deletion | Q (Proximal) | AGTGTGATCACTTGGGTGTGCTG | ; | CCCAGGAATCATCTTTACCA | 1 | 1 | 2 | 0.04% (SEQ ID NO. 5692, 5693) |
| 62bp deletion | D (Distal) | GGCTCACTATGCTGCCGCCC | ; | TCTGGAATCTTCTCATCATCCTCC | 0 | 2 | 2 | 0.04% (SEQ ID NO. 5694, 5695) |
| A->T transversion | D (Distal) | GGCTCACTATGCTGCCGCCCTGTGGGACTTTGGAAATACAATGTG | | | 0 | 2 | 2 | 0.04% (SEQ ID NO. 5696) |
| 8bp deletion | D (Distal) | GGCTCACTATGCTGCCGCCC | ; | TTTGGAAATACAATGTGTCAACTCT | 1 | 0 | 1 | 0.02% (SEQ ID NO. 5697, 5698) |
| 195bp deletion | DQ (Both) | GGCTCACTATGCTGCCGCCC | ; | CCCAAGATCATCTTTACCAGATCT | 1 | 0 | 1 | 0.02% (SEQ ID NO. 5699, 5700) |
| 207bp deletion | DQ (Both) | CCTTCGGCTCACTATGCTGCCGC | ; | CCCAGGAATCATCTTTACCA | 1 | 0 | 1 | 0.02% (SEQ ID NO. 5701, 5702) |
| 1bp deletion | Q (Proximal) | TGGGTGGTGGCTGTGTTTGCGTCTC | ; | CCCAGGAATCATCTTTACCA | 1 | 0 | 1 | 0.02% (SEQ ID NO. 5703, 5704) |
| 17bp deletion | D (Distal) | GGCTCACTATGCTGCCGCCC | ; | ACAATGTCAACTCTTGACAGGGC | 0 | 1 | 1 | 0.02% (SEQ ID NO. 5705, 5706) |
| A deletion | D (Distal) | GGCTCACTATGCTGCCGCCC | ; | GTGGGACTTTGGAAATTCAATGTGT | 0 | 1 | 1 | 0.02% (SEQ ID NO. 5707, 5708) |
| 205bp deletion w/ G insertion | DQ (Both) | GGCTCACTATGCTGCCGCCC | ; | GCCCAGGAATCATCTTTACCAGATC | 0 | 1 | 1 | 0.02% (SEQ ID NO. 5709, 5710) |
| 187bp deletion w/ 1bp deletion 1bp 5' of proximal guide PAM | DQ (Both) | GGCTCACTATGCTGCCGCCC | ; | GGCTGTGTTTGCGTCTCTCCAGGAA | 0 | 1 | 1 | 0.02% (SEQ ID NO. 5711, 5712) |
| 218bp deletion | DQ (Both) | TCTTACTGTCCCCTTCTGCGTCTCT | ; | CCCAGGAATCATCTTTACCA | 0 | 1 | 1 | 0.02% (SEQ ID NO. 5713, 5714) |
| C insertion | Q (Proximal) | GGTGGTGGCTGTGTTTGCGTCTCTC | ; | CCCAGGAATCATCTTTACCA | 0 | 1 | 1 | 0.02% (SEQ ID NO. 5715, 5716) |

FIG. 23 cont.

Table 5. Off-Target Sites with Statistically Significant Mutational Burden

| Guide | Degenerate Sequence | Predicted Binding Site | | | Fisher's Exact Test p | | N-Fold Enrichment | | |
|---|---|---|---|---|---|---|---|---|---|
| | | Chr | Start | End | InDel | Split | InDel | Split | |
| B | CCAGGAATCATCTTTACTAAATG | 3 | 46,399,538 | 46,399,561 | 4.4x10^-13 | 1.0000 | 3.51 | 0.47 | (SEQ ID NO. 5717) |
| B | CCAGGCATCTTCTTTACCAGCTC | 8 | 104,258,547 | 104,258,570 | 0.0165 | 1.0000 | 1.93 | 0.45 | (SEQ ID NO. 5718) |
| C | AAAATGTGTCAACTCTTGATTAG | 12 | 12,976,312 | 12,976,335 | 0.0361 | 1.0000 | 1.56 | 0.27 | (SEQ ID NO. 5719) |
| C | AAAATGTGTCAACTCTTGATTAG | 12 | 12,976,312 | 12,976,335 | 0.0361 | 1.0000 | 1.56 | 0.27 | (SEQ ID NO. 5720) |
| C | CCCACTGGGCTGCAGAATACAGA | 10 | 129,722,982 | 129,723,005 | 0.0338 | 0.9996 | 1.82 | 0.50 | (SEQ ID NO. 5721) |
| Q | TCTGTGTTGCCTCTCTCTCAGG | 12 | 19,270,661 | 19,270,684 | 0.0086 | 1.0000 | 2.08 | 0.20 | (SEQ ID NO. 5722) |
| Q | CCCGGGAGGAGGCAAAACAGC | 17 | 11,833,418 | 11,833,441 | 0.0083 | 1.0000 | 2.24 | 0.20 | (SEQ ID NO. 5723) |

FIG. 24

Table T6. Comparison of On- and Off-Target Mutational Burdens

| gRNA | gRNA Combinations Tested | On-Target Site | | Most Significant Off-Target Site | |
|---|---|---|---|---|---|
| | | Mutation Frequency | Variant Read Enrichment (Treatment vs. Control) | Variant Read Enrichment (Treatment vs. Control) | Fisher's Exact p (Treatment vs Control) |
| A | A, AB | 5.79% | 58.59 | 1.84 | 0.1616 |
| B | B, AB | 16.65% | 51.02 | 3.51 | 4.416x10^-13 |
| C | C, CD | 17.02% | 30.88 | 1.56 | 0.0361 |
| D | D, CD, DQ | 26.23% | 57.64 | 1.82 | 0.0338 |
| Q | DQ | 21.19% | 46.84 | 2.24 | 0.0083 |

FIG. 25

THERAPEUTIC USES OF GENOME EDITING WITH CRISPR/CAS SYSTEMS

RELATED APPLICATIONS

This application is a continuation-in-part of PCT Application No. PCT/US2014/46034, filed Jul. 9, 2014, which claims the benefit of U.S. Provisional Application Nos. 61/844,333, filed on Jul. 9, 2013, and 61/869,369, filed on Aug. 23, 2013. The entire teachings of the above applications are incorporated herein by reference.

GOVERNMENT SUPPORT

This invention was made with government support under HL118744, HL098364, DK095384 and HL107440 awarded by the National Institutes of Health. The government has certain rights in the invention.

BACKGROUND OF THE INVENTION

Clustered regularly interspaced short palindromic repeats (CRISPR)/CRISPR-associated (Cas) systems are a new class of genome-editing tools that target desired genomic sites in mammalian cells. Recently published type II CRISPR/Cas systems use Cas9 nuclease that is targeted to a genomic site by complexing with a synthetic guide RNA that hybridizes to a 20-nucleotide DNA sequence and immediately preceding an NGG motif recognized by Cas9 (thus, a $(N)_{20}$NGG target DNA sequence). This results in a double-strand break three nucleotides upstream of the NGG motif. The double strand break instigates either non-homologous end-joining, which is error-prone and conducive to frameshift mutations that knock out gene alleles, or homology-directed repair, which can be exploited with the use of an exogenously introduced double-strand or single-strand DNA repair template to knock in or correct a mutation in the genome. Thus, CRISPR/Cas systems could be useful tools for therapeutic applications, but unfortunately prior published reports have demonstrated an efficiency of allele targeting of only 2%-4% in human stem cells (Mali et al., *Science* 339:823-826 (2013)).

SUMMARY OF THE INVENTION

Work described herein demonstrates methods of allele targeting using CRISPR/Cas systems resulting in mutant cells with efficiencies of up to 80%. These vastly improved methods permit CRISPR/Cas systems to be utilized effectively for the first time for therapeutic purposes. Methods of delivery of CRISPR/Cas systems to human stem cells are provided. In addition, methods of specifically identifying useful RNA guide sequences are provided, along with particular guide sequences useful in targeting specific genes (e.g., ADA, AK2, CD3D, DCLRE1C, IL2RG, IL7R, JAK3, LIG4, NHEJ1, PNP, PRKDC, RAG1, RAG2, ZAP70 and HBB). Moreover, methods of treatment (e.g., severe combined immunodeficiency, sickle cell disease, e.g., sickle cell anemia, beta thalassemia, etc.) utilizing the compositions and methods disclosed herein are provided. In some aspects, disclosed herein is a method for altering a target severe combined immunodeficiency (SCID)-associated polynucleotide sequence in a cell comprising contacting the SCID-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCID-associated polynucleotide sequence, wherein the target SCID-associated polynucleotide sequence is cleaved.

In some aspects, disclosed herein is a method for treating or preventing a disorder associated with expression of a SCID-associated polynucleotide sequence in a subject, the method comprising (a) altering a target SCID-associated polynucleotide sequence in a cell ex vivo by contacting the SCID-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCID-associated polynucleotide sequence, wherein the target SCID-associated polynucleotide sequence is cleaved, and (b) introducing the cell into the subject, thereby treating or preventing a disorder associated with expression of the SCID-associated polynucleotide sequence.

In some aspects, disclosed herein is a method for treating or preventing a disorder associated with expression of a SCID-associated polynucleotide sequence in a subject, the method comprising altering a target SCID-associated polynucleotide sequence in a cell by contacting the SCID-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCID-associated polynucleotide sequence, and wherein the target SCID-associated polynucleotide sequence is cleaved, thereby treating or preventing a disorder associated with expression of the SCID-associated polynucleotide sequence.

In some aspects, disclosed herein is a method for simultaneously altering multiple target SCID-associated polynucleotide sequences in a cell comprising contacting the SCID-associated polynucleotide sequences with a clustered regularly interspaced short palindromic repeats-associated (Cas) protein and multiple ribonucleic acids, wherein the ribonucleic acids direct Cas protein to and hybridize to target motifs of the target SCID-associated polynucleotide sequences, wherein the target SCID-associated polynucleotide sequences are cleaved.

In some aspects, disclosed herein is a method for treating or preventing a disorder associated with expression of SCID-associated polynucleotide sequences in a subject, the method comprising (a) altering target SCID-associated polynucleotide sequences in a cell ex vivo by contacting the SCID-associated polynucleotide sequences with a clustered regularly interspaced short palindromic repeats-associated (Cas) protein and multiple ribonucleic acids, wherein the ribonucleic acids direct Cas protein to and hybridize to target motifs of the target SCID-associated polynucleotide sequences, wherein the target SCID-associated polynucleotide sequences are cleaved, and (b) introducing the cell into the subject, thereby treating or preventing a disorder associated with expression of the SCID-associated polynucleotide sequences.

In some aspects, disclosed herein is a method for treating or preventing a disorder associated with expression of SCID-associated polynucleotide sequences in a subject, the method comprising altering target SCID-associated polynucleotide sequences in a cell by contacting the SCID-associated polynucleotide sequences with a clustered regularly interspaced short palindromic repeats-associated (Cas) protein and multiple ribonucleic acids, wherein the ribonucleic acids direct Cas protein to and hybridize to target moieties of the target SCID-associated polynucleotide sequences, and wherein the target SCID-associated polynucleotide sequences are cleaved, thereby treating or preventing a disorder associated with expression of the SCID-associated polynucleotide sequences.

In some aspects, disclosed herein is a method for altering a target sickle cell disease (SCD)-associated polynucleotide sequence in a cell comprising contacting the SCD-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCD-associated polynucleotide sequence, wherein the target SCD-associated polynucleotide sequence is cleaved.

In some aspects, disclosed herein is a method for treating or preventing a disorder associated with expression of a SCD-associated polynucleotide sequence in a subject, the method comprising (a) altering a target SCD-associated polynucleotide sequence in a cell ex vivo by contacting the SCD-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCD-associated polynucleotide sequence, wherein the target SCD-associated polynucleotide sequence is cleaved, and (b) introducing the cell into the subject, thereby treating or preventing a disorder associated with expression of the SCD-associated polynucleotide sequence.

In some aspects, disclosed herein is a method for treating or preventing a disorder associated with expression of a SCD-associated polynucleotide sequence in a subject, the method comprising altering a target SCD-associated polynucleotide sequence in a cell by contacting the SCD-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCD-associated polynucleotide sequence, and wherein the target SCD-associated polynucleotide sequence is cleaved, thereby treating or preventing a disorder associated with expression of the SCD-associated polynucleotide sequence.

In some aspects, disclosed herein is a method for simultaneously altering multiple target SCD-associated polynucleotide sequences in a cell comprising contacting the SCD-associated polynucleotide sequences with a clustered regularly interspaced short palindromic repeats-associated (Cas) protein and multiple ribonucleic acids, wherein the ribonucleic acids direct Cas protein to and hybridize to target motifs of the target SCD-associated polynucleotide sequences, wherein the target SCD-associated polynucleotide sequences are cleaved.

In some aspects, disclosed herein is a method for treating or preventing a disorder associated with expression of SCD-associated polynucleotide sequences in a subject, the method comprising (a) altering target SCD-associated polynucleotide sequences in a cell ex vivo by contacting the SCD-associated polynucleotide sequences with a clustered regularly interspaced short palindromic repeats-associated (Cas) protein and multiple ribonucleic acids, wherein the ribonucleic acids direct Cas protein to and hybridize to target motifs of the target SCD-associated polynucleotide sequences, wherein the target SCD-associated polynucleotide sequences are cleaved, and (b) introducing the cell into the subject, thereby treating or preventing a disorder associated with expression of the SCD-associated polynucleotide sequences.

In some aspects, disclosed herein is a method for treating or preventing a disorder associated with expression of SCD-associated polynucleotide sequences in a subject, the method comprising altering target SCD-associated polynucleotide sequences in a cell by contacting the SCD-associated polynucleotide sequences with a clustered regularly interspaced short palindromic repeats-associated (Cas) protein and multiple ribonucleic acids, wherein the ribonucleic acids direct Cas protein to and hybridize to target moieties of the target SCD-associated polynucleotide sequences, and wherein the target SCD-associated polynucleotide sequences are cleaved, thereby treating or preventing a disorder associated with expression of the SCD-associated polynucleotide sequences.

In some aspects, disclosed herein is a method for altering a target beta thalassemia-associated polynucleotide sequence in a cell comprising contacting the beta thalassemia-associated polynucleotide sequence with a clustered regularly interspaced short palindromic repeats-associated (Cas) protein and from one to two ribonucleic acids, wherein the ribonucleic acids direct Cas protein to and hybridize to a target motif of the target beta thalassemia-associated polynucleotide sequence, wherein the target beta thalassemia-associated polynucleotide sequence is cleaved.

In some aspects, disclosed herein is a method for treating or preventing a disorder associated with expression of a beta thalassemia-associated polynucleotide sequence in a subject, the method comprising (a) altering a target beta thalassemia-associated polynucleotide sequence in a cell ex vivo by contacting the beta thalassemia-associated polynucleotide sequence with a clustered regularly interspaced short palindromic repeats-associated (Cas) protein and from one to two ribonucleic acids, wherein the ribonucleic acids direct Cas protein to and hybridize to a target motif of the target beta thalassemia-associated polynucleotide sequence, wherein the target beta thalassemia-associated polynucleotide sequence is cleaved, and (b) introducing the cell into the subject, thereby treating or preventing a disorder associated with expression of the beta thalassemia-associated polynucleotide sequence.

In some aspects, disclosed herein is a method for treating or preventing a disorder associated with expression of a beta thalassemia-associated polynucleotide sequence in a subject, the method comprising altering a target beta thalassemia-associated polynucleotide sequence in a cell by contacting the beta thalassemia-associated polynucleotide sequence with a clustered regularly interspaced short palindromic repeats-associated (Cas) protein and from one to two ribonucleic acids, wherein the ribonucleic acids direct Cas protein to and hybridize to a target motif of the target beta thalassemia-associated polynucleotide sequence, and wherein the target beta thalassemia-associated polynucleotide sequence is cleaved, thereby treating or preventing a disorder associated with expression of the beta thalassemia-associated polynucleotide sequence.

In some aspects, disclosed herein is a method for simultaneously altering multiple target beta thalassemia-associated polynucleotide sequences in a cell comprising contacting the beta thalassemia-associated polynucleotide sequences with a clustered regularly interspaced short palindromic repeats-associated (Cas) protein and multiple ribonucleic acids, wherein the ribonucleic acids direct Cas protein to and hybridize to target motifs of the target beta thalassemia-associated polynucleotide sequences, wherein the target beta thalassemia-associated polynucleotide sequences are cleaved.

In some aspects, disclosed herein is a method for treating or preventing a disorder associated with expression of beta thalassemia-associated polynucleotide sequences in a subject, the method comprising (a) altering target beta thalassemia-associated polynucleotide sequences in a cell ex vivo by contacting the beta thalassemia-associated polynucleotide sequences with a clustered regularly interspaced short palindromic repeats-associated (Cas) protein and multiple ribonucleic acids, wherein the ribonucleic acids direct Cas protein to and hybridize to target motifs of the target beta thalassemia-associated polynucleotide sequences, wherein the target beta thalassemia-associated polynucleotide sequences are cleaved, and (b) introducing the cell into the subject, thereby treating or preventing a disorder associated with expression of the beta thalassemia-associated polynucleotide sequences.

In some aspects, disclosed herein is a method for treating or preventing a disorder associated with expression of beta thalassemia-associated polynucleotide sequences in a subject, the method comprising altering target beta thalassemia-associated polynucleotide sequences in a cell by contacting the beta thalassemia-associated polynucleotide sequences with a clustered regularly interspaced short palindromic repeats-associated (Cas) protein and multiple ribonucleic acids, wherein the ribonucleic acids direct Cas protein to and hybridize to target moieties of the target beta thalassemia-associated polynucleotide sequences, and wherein the target beta thalassemia-associated polynucleotide sequences are cleaved, thereby treating or preventing a disorder associated with expression of the beta thalassemia-associated polynucleotide sequences.

In some embodiments, the Cas protein is *Streptococcus pyogenes* Cas9 protein or a functional portion thereof. In some embodiments, the functional portion comprises a combination of operably linked Cas9 protein functional domains selected from the group consisting of a DNA binding domain, at least one RNA binding domain, a helicase domain, and an endonuclease domain. In some embodiments, the functional domains form a complex. In some embodiments, the Cas protein is Cas9 protein from any bacterial species or functional portion thereof. In some embodiments, the functional portion comprises a combination of operably linked Cas9 protein functional domains selected from the group consisting of a DNA binding domain, at least one RNA binding domain, a helicase domain, and an endonuclease domain. In some embodiments, the functional domains form a complex.

In some embodiments, the Cas protein is complexed with the one to two ribonucleic acids. In some embodiments, the Cas protein is complexed with the multiple ribonucleic acids.

In some embodiments, the target motif is a 20-nucleotide DNA sequence. In some embodiments, each target motif is a 20-nucleotide DNA sequence. In some embodiments, the target motif is a 20-nucleotide DNA sequence beginning with G and immediately precedes an NGG motif recognized by the Cas protein. In some embodiments, each target motif is a 20-nucleotide DNA sequence beginning with G and immediately precedes an NGG motif recognized by the Cas protein. In some embodiments, the target motif is a 20-nucleotide DNA sequence and immediately precedes an NGG motif recognized by the Cas protein. In some embodiments, each target motif is a 20-nucleotide DNA sequence and immediately precedes an NGG motif recognized by the Cas protein. In some embodiments, the target motif is $G(N)_{19}NGG$. In some embodiments, each target motif is $G(N)_{19}NGG$. In some embodiments, the target motif is $(N)_{20}NGG$. In some embodiments, each target motif is $(N)_{20}NGG$.

In some embodiments, the target polynucleotide sequence is cleaved such that a double-strand break results. In some embodiments, each target polynucleotide sequence is cleaved such that a double-strand break results. In some embodiments, the target polynucleotide sequence is cleaved such that a single-strand break results. In some embodiments, each target polynucleotide sequence is cleaved such that a single-strand break results.

In some embodiments, the alteration is an indel. In some embodiments, the alteration results in reduced expression of the target polynucleotide sequence. In some embodiments, the alteration results in reduced expression of the target polynucleotide sequences. In some embodiments, the alteration results in a knock out of the target polynucleotide sequence. In some embodiments, the alteration results in a knock out of the target polynucleotide sequences. In some embodiments, the alteration results in correction of the target polynucleotide sequence from an undesired sequence to a desired sequence. In some embodiments, the alteration results in correction of the target polynucleotide sequences from undesired sequences to desired sequences. In some embodiments, the alteration is a homozygous alteration. In some embodiments, each alteration is a homozygous alteration.

In some embodiments, subsequent to cleavage of the target polynucleotide sequence, homology-directed repair occurs. In some embodiments, homology-directed repair is performed using an exogenously introduced DNA repair template. In some embodiments, the exogenously introduced DNA repair template is single-stranded. In some embodiments, the exogenously introduced DNA repair template is double-stranded. In some embodiments, subsequent to cleavage of the target polynucleotide sequences, homology-directed repair occurs. In some embodiments, homology-directed repair is performed using an exogenously introduced DNA repair template. In some embodiments, the exogenously introduced DNA repair template is single-stranded. In some embodiments, the exogenously introduced DNA repair template is double-stranded.

In some embodiments, the cell is a peripheral blood cell. In some embodiments, the cell is a stem cell or a pluripotent cell. In some embodiments, the cell is a hematopoietic stem cell. In some embodiments, the cell is a $CD34^+$ cell. In some embodiments, the cell is a $CD34^+$ mobilized peripheral blood cell. In some embodiments, the cell is a $CD34^+$ cord blood cell. In some embodiments, the cell is a $CD34^+$ bone marrow cell. In some embodiments, the cell is a $CD34^+$ $CD38$-Lineage-$CD90^+CD45RA^-$ cell.

In some embodiments, the target polynucleotide sequence is ADA. In some embodiments, at least one of the one to two ribonucleic acids comprises a sequence selected from the group consisting of the ribonucleic acid sequences of FIG. 1 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 1 or at least a 12 nucleotide fragment thereof.

In some embodiments, the target polynucleotide sequence is AK2. In some embodiments, at least one of the one to two ribonucleic acids comprises a sequence selected from the group consisting of the ribonucleic acid sequences of FIG.

2 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 2 or at least a 12 nucleotide fragment thereof.

In some embodiments, the target polynucleotide sequence is CD3D. In some embodiments, at least one of the one to two ribonucleic acids comprises a sequence selected from the group consisting of the ribonucleic acid sequences of FIG. 3 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 3 or at least a 12 nucleotide fragment thereof.

In some embodiments, the target polynucleotide sequence is DCLRE1C. In some embodiments, at least one of the one to two ribonucleic acids comprises a sequence selected from the group consisting of the ribonucleic acid sequences of FIG. 4 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 4 or at least a 12 nucleotide fragment thereof.

In some embodiments, the target polynucleotide sequence is IL2RG. In some embodiments, at least one of the one to two ribonucleic acids comprises a sequence selected from the group consisting of the ribonucleic acid sequences of FIG. 6 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 6 or at least a 12 nucleotide fragment thereof.

In some embodiments, the target polynucleotide sequence is IL7R. In some embodiments, at least one of the one to two ribonucleic acids comprises a sequence selected from the group consisting of the ribonucleic acid sequences of FIG. 7 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 7 or at least a 12 nucleotide fragment thereof.

In some embodiments, the target polynucleotide sequence is JAK3. In some embodiments, at least one of the one to two ribonucleic acids comprises a sequence selected from the group consisting of the ribonucleic acid sequences of FIG. 8 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 8 or at least a 12 nucleotide fragment thereof.

In some embodiments, the target polynucleotide sequence is LIG4. In some embodiments, at least one of the one to two ribonucleic acids comprises a sequence selected from the group consisting of the ribonucleic acid sequences of FIG. 9 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 9 or at least a 12 nucleotide fragment thereof.

In some embodiments, the target polynucleotide sequence is NHEJ1. In some embodiments, at least one of the one to two ribonucleic acids comprises a sequence selected from the group consisting of the ribonucleic acid sequences of FIG. 10 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 10 or at least a 12 nucleotide fragment thereof.

In some embodiments, the target polynucleotide sequence is PNP. In some embodiments, at least one of the one to two ribonucleic acids comprises a sequence selected from the group consisting of the ribonucleic acid sequences of FIG. 11 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 11 or at least a 12 nucleotide fragment thereof.

In some embodiments, the target polynucleotide sequence is PRKDC. In some embodiments, at least one of the one to two ribonucleic acids comprises a sequence selected from the group consisting of the ribonucleic acid sequences of FIG. 12 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 12 or at least a 12 nucleotide fragment thereof.

In some embodiments, the target polynucleotide sequence is RAG1. In some embodiments, at least one of the one to two ribonucleic acids comprises a sequence selected from the group consisting of the ribonucleic acid sequences of FIG. 13 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 13 or at least a 12 nucleotide fragment thereof.

In some embodiments, the target polynucleotide sequence is RAG2. In some embodiments, at least one of the one to two ribonucleic acids comprises a sequence selected from the group consisting of the ribonucleic acid sequences of FIG. 14 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 14 or at least a 12 nucleotide fragment thereof.

In some embodiments, the target polynucleotide sequence is ZAP70. In some embodiments, at least one of the one to two ribonucleic acids comprises a sequence selected from the group consisting of the ribonucleic acid sequences of FIG. 15 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 15 or at least a 12 nucleotide fragment thereof.

In some embodiments, the target polynucleotide sequence is HBB. In some embodiments, at least one of the one to two ribonucleic acids comprises a sequence selected from the group consisting of the ribonucleic acid sequences of FIG. 5 or at least a 12 nucleotide fragment thereof. In some embodiments, at least one of the one to two ribonucleic acids comprises a sequence with a single nucleotide mismatch to a sequence selected from the group consisting of the ribonucleic acid sequences of FIG. 5 or at least a 12 nucleotide fragment thereof. In some embodiments, at least one of the one to two ribonucleic acids comprises a sequence of GTAACGGCAGACTTCTCCACAGG (SEQ ID NO: 5321) or at least a 12 nucleotide fragment thereof. In some embodiments, at least one of the one to two ribonucleic acids comprises a sequence with a single nucleotide mismatch to ribonucleic acid sequence GTAACGGCAGACTTCTCCACAGG (SEQ ID NO: 5321) or at least a 12 nucleotide fragment thereof.

In some embodiments, the target polynucleotide sequences comprise multiple different portions of ADA. In some embodiments, each of the multiple ribonucleic acids comprises a different sequence selected from the group consisting of the ribonucleic acid sequences of FIG. 1 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 1 or at least 12 nucleotide fragments thereof.

In some embodiments, the target polynucleotide sequences comprise multiple different portions of AK2. In some embodiments, each of the multiple ribonucleic acids comprises a different sequence selected from the group consisting of the ribonucleic acid sequences of FIG. 2 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 2 or at least 12 nucleotide fragments thereof.

In some embodiments, the target polynucleotide sequences comprise multiple different portions of CD3D. In some embodiments, each of the multiple ribonucleic acids comprises a different sequence selected from the group consisting of the ribonucleic acid sequences of FIG. 3 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 3 or at least 12 nucleotide fragments thereof.

In some embodiments, the target polynucleotide sequences comprise multiple different portions of DCLRE1C. In some embodiments, each of the multiple ribonucleic acids comprises a different sequence selected from the group consisting of the ribonucleic acid sequences of FIG. 4 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 4 or at least 12 nucleotide fragments thereof.

In some embodiments, the target polynucleotide sequences comprise multiple different portions of IL2RG. In some embodiments, each of the multiple ribonucleic acids comprises a different sequence selected from the group consisting of the ribonucleic acid sequences of FIG. 6 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 6 or at least 12 nucleotide fragments thereof.

In some embodiments, the target polynucleotide sequences comprise multiple different portions of IL7R. In some embodiments, each of the multiple ribonucleic acids comprises a different sequence selected from the group consisting of the ribonucleic acid sequences of FIG. 7 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 7 or at least 12 nucleotide fragments thereof.

In some embodiments, the target polynucleotide sequences comprise multiple different portions of JAK3. In some embodiments, each of the multiple ribonucleic acids comprises a different sequence selected from the group consisting of the ribonucleic acid sequences of FIG. 8 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 8 or at least 12 nucleotide fragments thereof.

In some embodiments, the target polynucleotide sequences comprise multiple different portions of LIG4. In some embodiments, each of the multiple ribonucleic acids comprises a different sequence selected from the group consisting of the ribonucleic acid sequences of FIG. 9 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 9 or at least 12 nucleotide fragments thereof.

In some embodiments, the target polynucleotide sequences comprise multiple different portions of NHEJ1. In some embodiments, each of the multiple ribonucleic acids comprises a different sequence selected from the group consisting of the ribonucleic acid sequences of FIG. 10 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 10 or at least 12 nucleotide fragments thereof.

In some embodiments, the target polynucleotide sequences comprise multiple different portions of PNP. In some embodiments, each of the multiple ribonucleic acids comprises a different sequence selected from the group consisting of the ribonucleic acid sequences of FIG. 11 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 11 or at least 12 nucleotide fragments thereof.

In some embodiments, the target polynucleotide sequences comprise multiple different portions of PRKDC. In some embodiments, each of the multiple ribonucleic acids comprises a different sequence selected from the group consisting of the ribonucleic acid sequences of FIG. 12 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 12 or at least 12 nucleotide fragments thereof.

In some embodiments, the target polynucleotide sequences comprise multiple different portions of RAG1. In some embodiments, each of the multiple ribonucleic acids comprises a different sequence selected from the group consisting of the ribonucleic acid sequences of FIG. 13 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 13 or at least 12 nucleotide fragments thereof.

In some embodiments, the target polynucleotide sequences comprise multiple different portions of RAG2. In some embodiments, each of the multiple ribonucleic acids comprises a different sequence selected from the group consisting of the ribonucleic acid sequences of FIG. 14 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 14 or at least 12 nucleotide fragments thereof.

In some embodiments, the target polynucleotide sequences comprise multiple different portions of ZAP70. In some embodiments, each of the multiple ribonucleic acids comprises a different sequence selected from the group consisting of the ribonucleic acid sequences of FIG. 15 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 15 or at least 12 nucleotide fragments thereof.

In some embodiments, the target polynucleotide sequences comprise multiple different portions of HBB. In some embodiments, each of the multiple ribonucleic acids comprises a different sequence selected from the group consisting of the ribonucleic acid sequences of FIG. 5 or at least 12 nucleotide fragments thereof. In some embodiments, each of the multiple ribonucleic acids comprises a sequence with a single nucleotide mismatch to a different sequence selected from the group consisting of the ribonucleic acid sequences of FIG. 5 or at least 12 nucleotide fragments thereof.

In some embodiments, the target polynucleotide sequences comprise at least a portion of any combination of target polynucleotide sequences selected from the group consisting of ADA, AK2, CD3D, DCLRE1C, IL2RG, IL7R, JAK3, LIG4, NHEJ1, PNP, PRKDC, RAG1, RAG2, and ZAP70. In some embodiments, each of the multiple ribonucleic acids comprises a different sequence selected from the group consisting of the ribonucleic acid sequences of FIGS. 1-15 or at least a 12 nucleotide fragment thereof. In some embodiments, each of the multiple ribonucleic acids comprises a sequence with a single nucleotide mismatch to a different sequence selected from the group consisting of the ribonucleic acid sequences of FIGS. 1-15 or at least a 12 nucleotide fragment thereof.

In some embodiments, the disorder is SCID. In some embodiments, the disorder is sickle cell disease. In some embodiments, the disorder is beta thalassemia.

In some embodiments, the one to two ribonucleic acids are designed to hybridize to a target motif immediately adjacent to a deoxyribonucleic acid motif recognized by the Cas protein. In some embodiments, each of the one to two ribonucleic acids are designed to hybridize to target motifs immediately adjacent to deoxyribonucleic acid motifs recognized by the Cas protein which flank a mutant allele located between the target motifs. In some embodiments, the multiple ribonucleic acids are designed to hybridize to target motifs immediately adjacent to deoxyribonucleic acid motifs recognized by the Cas protein. In some embodiments, the multiple ribonucleic acids are designed to hybridize to target motifs immediately adjacent to deoxyribonucleic acid motifs recognized by the Cas protein which flank mutant alleles located between the target motifs. In some embodiments, the one to two ribonucleic acids are selected to minimize hybridization with nucleic acid sequences other than the target polynucleotide sequence. In some embodiments, the multiple ribonucleic acids are selected to minimize hybridization with nucleic acid sequences other than the target polynucleotide sequence. In some embodiments, the target motif is selected such that it contains at least two mismatches when compared with all other genomic nucleotide sequences in the cell. In some embodiments, each target motif is selected such that it contains at least two mismatches when compared with all other genomic nucleotide sequences in the cell. In some embodiments, the target motif is selected such that it contains at least one mismatch when compared with all other genomic nucleotide sequences in the cell. In some embodiments, the target motif is selected such that it contains at least one mismatch when compared with all other genomic nucleotide sequences in the cell. In some embodiments, the one to two ribonucleic acids hybridize to a target motif that it contains at least two mismatches when compared with all other genomic nucleotide sequences in the cell. In some embodiments, each of the multiple ribonucleic acids hybridize to target motifs that contain at least two mismatches when compared with all other genomic nucleotide sequences in the cell. In some embodiments, the one to two ribonucleic acids hybridize to a target motif that contains at least one mismatch when compared with all other genomic nucleotide sequences in the cell. In some embodiments, each of the multiple ribonucleic acids hybridize to target motifs that contain at least one mismatch when compared with all other genomic nucleotide sequences in the cell.

In some embodiments, the Cas protein and the one to two ribonucleic acids are contained in a nanoparticle. In some embodiments, the Cas protein and the one to two ribonucleic acids are contained in a lipid nanoparticle. In some embodiments, the lipid nanoparticle comprises at least one of a cationic lipid, a neutral lipid, an amino lipid, a sterol, and a PEG or PEG-modified lipid. In some embodiments, the cationic lipid is selected from the group consisting of ALNY-100, C12-200, DODAC, DDAB, DOTAP, DOTMA, DODMA, DLinDMA, DLenDMA, DLin-C-DAP, DLin-DAC, DLin-MA, DLinDAP, DLin-S-DMA, DLin-2-DMAP, DLin-TMA.Cl, DLin-TAP.Cl, DLin-MPZ, DLinAP, DOAP, DLin-EG-DMA, DLinDMA, DLin-K-DMA, DLin-KC2-DMA, DLin-M-C3-DMA, KC2, MC3, DOTAP.Cl, DOSPA, DOGS, DOPE, DODAP, DMRIE, XTC, and mixtures thereof. In some embodiments, the neutral lipid is selected from the group consisting of DPSC, DPPC, POPC, DOPE, SM, and mixtures thereof. In some embodiments, the PEG-modified lipid is selected from the group consisting of PEG-DMG, PEG-CerC14, PEG-CerC20, and mixtures thereof. In some embodiments, the Cas protein and the multiple ribonucleic acids are contained in nanoparticles. In some embodiments, the Cas protein and the multiple ribonucleic acids are contained in lipid nanoparticles. In some embodiments, the lipid nanoparticles comprise at least one of a cationic lipid, a neutral lipid, an amino lipid, a sterol, and a PEG or PEG-modified lipid. In some embodiments, the cationic lipid is selected from the group consisting of ALNY-100, C12-200, DODAC, DDAB, DOTAP, DOTMA, DODMA, DLinDMA, DLenDMA, DLin-C-DAP, DLin-DAC, DLin-MA, DLinDAP, DLin-S-DMA, DLin-2-DMAP, DLin-TMA.Cl, DLin-TAP.Cl, DLin-MPZ, DLinAP, DOAP, DLin-EG-DMA, DLinDMA, DLin-K-DMA, DLin-KC2-DMA, DLin-M-C3-DMA, KC2, MC3, DOTAP.Cl, DOSPA, DOGS, DOPE, DODAP, DMRIE, XTC, and mixtures thereof. In some embodiments, the neutral lipid is selected from the group consisting of DPSC, DPPC, POPC, DOPE, SM, and mixtures thereof. In some embodiments, the PEG-modified lipid is selected from the group consisting of PEG-DMG, PEG-CerC14, PEG-CerC20, and mixtures thereof.

In some embodiments, the efficiency of alteration at each loci is from about 50% to about 80%. In some embodiments, the efficiency of alteration is at least about 5%. In some embodiments, the efficiency of alteration is at least about 10%. In some embodiments, the efficiency of alteration is from about 50% to about 80%.

In some embodiments, the Cas protein is encoded by a modified nucleic acid. In some embodiments, the modified nucleic acid comprises a ribonucleic acid containing at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate. In some embodiments, at least one of the ribonucleic acids is a modified ribonucleic acid comprising one to two modified nucleotides selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate.

In some embodiments, any of the Cas protein or the ribonucleic acids are expressed from a plasmid. In some embodiments, any of the Cas protein or the ribonucleic acids are expressed using a promoter optimized for increased expression in stem cells. In some embodiments, the promoter is selected from the group consisting of a Cytomegalovirus (CMV) early enhancer element and a chicken beta-actin promoter, a chicken beta-actin promoter, an elongation factor-1 alpha promoter, and a ubiquitin promoter.

In some embodiments, the method further comprises selecting cells that express the Cas protein. In some embodiments, selecting cells comprises FACS. In some embodiments, FACs is used to select cells which co-express Cas and a fluorescent protein selected from the group consisting of green fluorescent protein and red fluorescent protein.

In some aspects, disclosed herein is a method for altering a target SCID-associated polynucleotide sequence in a cell comprising contacting the SCID-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target SCID-associated polynucleotide sequence, wherein the target SCID-associated polynucleotide sequence is cleaved, and wherein the efficiency of alteration of cells that express Cas protein is from about 8% to about 80%.

In some aspects, disclosed herein is a method for altering a target SCD-associated polynucleotide sequence in a cell comprising contacting the SCD-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target SCD-associated polynucleotide sequence, wherein the target SCD-associated polynucleotide sequence is cleaved, and wherein the efficiency of alteration of cells that express Cas protein is from about 8% to about 80%.

In some aspects, disclosed herein is a method for altering a target beta thalassemia-associated polynucleotide sequence in a cell comprising contacting the beta thalassemia-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target beta thalassemia-associated polynucleotide sequence, wherein the target beta thalassemia-associated polynucleotide sequence is cleaved, and wherein the efficiency of alteration of cells that express Cas protein is from about 8% to about 80%.

In some aspects, disclosed herein is a method for treating or preventing a disorder associated with expression of a SCID-associated polynucleotide sequence in a subject, the method comprising (a) altering a target SCID-associated polynucleotide sequence in a cell ex vivo by contacting the SCID-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target SCID-associated polynucleotide sequence, wherein the target SCID-associated polynucleotide sequence is cleaved, and wherein the efficiency of alteration is from about 8% to about 80%, and (b) introducing the cell into the subject, thereby treating or preventing a disorder associated with expression of the SCID-associated polynucleotide sequence.

In some aspects, disclosed herein is a method for treating or preventing a disorder associated with expression of a SCD-associated polynucleotide sequence in a subject, the method comprising (a) altering a target SCD-associated polynucleotide sequence in a cell ex vivo by contacting the SCD-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target SCD-associated polynucleotide sequence, wherein the target SCD-associated polynucleotide sequence is cleaved, and wherein the efficiency of alteration is from about 8% to about 80%, and (b) introducing the cell into the subject, thereby treating or preventing a disorder associated with expression of the SCD-associated polynucleotide sequence.

In some aspects, disclosed herein is a method for treating or preventing a disorder associated with expression of a beta thalassemia-associated polynucleotide sequence in a subject, the method comprising (a) altering a target beta thalassemia-associated polynucleotide sequence in a cell ex vivo by contacting the beta thalassemia-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target beta thalassemia-associated polynucleotide sequence, wherein the target beta thalassemia-associated polynucleotide sequence is cleaved, and wherein the efficiency of alteration is from about 8% to about 80%, and (b) introducing the cell into the subject, thereby treating or preventing a disorder associated with expression of the beta thalassemia-associated polynucleotide sequence.

In some aspects, disclosed herein is a method for simultaneously altering multiple target SCID-associated polynucleotide sequences in a cell comprising contacting the SCID-associated polynucleotide sequences in a cell selected from the group consisting of a human pluripotent cell, a primary human cell, and a non-transformed human cell, with a clustered regularly interspaced short palindromic repeats-associated (Cas) protein and multiple ribonucleic acids, wherein the ribonucleic acids direct Cas protein to and hybridize to target motifs of the target SCID-associated polynucleotide sequences, wherein the target SCID-associated polynucleotide sequences are cleaved, and wherein the efficiency of alteration of cells that express Cas protein is from about 8% to about 80%.

In some aspects, disclosed herein is a method for simultaneously altering multiple target SCD-associated polynucleotide sequences in a cell comprising contacting the SCD-associated polynucleotide sequences in a cell selected from the group consisting of a human pluripotent cell, a primary human cell, and a non-transformed human cell, with a clustered regularly interspaced short palindromic repeats-associated (Cas) protein and multiple ribonucleic acids, wherein the ribonucleic acids direct Cas protein to and hybridize to target motifs of the target SCD-associated polynucleotide sequences, wherein the target SCD-associated polynucleotide sequences are cleaved, and wherein the efficiency of alteration of cells that express Cas protein is from about 8% to about 80%.

In some aspects, disclosed herein is a method for simultaneously altering multiple target beta thalassemia-associated polynucleotide sequences in a cell comprising contacting the beta thalassemia-associated polynucleotide sequences in a cell selected from the group consisting of a human pluripotent cell, a primary human cell, and a non-transformed human cell, with a clustered regularly interspaced short palindromic repeats-associated (Cas) protein and multiple ribonucleic acids, wherein the ribonucleic acids direct Cas protein to and hybridize to target motifs of the target beta thalassemia-associated polynucleotide sequences, wherein the target beta thalassemia-associated polynucleotide sequences are cleaved, and wherein the efficiency of alteration of cells that express Cas protein is from about 8% to about 80%.

In some aspects, disclosed herein is a method for treating or preventing a disorder associated with expression of SCID-associated polynucleotide sequences in a subject, the method comprising (a) altering target SCID-associated polynucleotide sequences in a cell ex vivo by contacting the SCID-associated polynucleotide sequences in a cell selected from the group consisting of a human pluripotent cell, a primary human cell, and a non-transformed human cell, with a clustered regularly interspaced short palindromic repeats-associated (Cas) protein and multiple ribonucleic acids, wherein the ribonucleic acids direct Cas protein to and hybridize to target motifs of the target SCID-associated polynucleotide sequences, wherein the target SCID-associated polynucleotide sequences are cleaved, and wherein the efficiency of alteration of cells that express Cas protein is from about 8% to about 80%, and (b) introducing the cell into the subject, thereby treating or preventing a disorder associated with expression of the SCID-associated polynucleotide sequences.

In some aspects, disclosed herein is a method for treating or preventing a disorder associated with expression of SCD-associated polynucleotide sequences in a subject, the method comprising (a) altering target SCD-associated polynucleotide sequences in a cell ex vivo by contacting the SCD-associated polynucleotide sequences in a cell selected from the group consisting of a human pluripotent cell, a primary human cell, and a non-transformed human cell, with a clustered regularly interspaced short palindromic repeats-associated (Cas) protein and multiple ribonucleic acids, wherein the ribonucleic acids direct Cas protein to and hybridize to target motifs of the target SCD-associated polynucleotide sequences, wherein the target SCD-associated polynucleotide sequences are cleaved, and wherein the efficiency of alteration of cells that express Cas protein is from about 8% to about 80%, and (b) introducing the cell into the subject, thereby treating or preventing a disorder associated with expression of the SCD-associated polynucleotide sequences.

In some aspects, disclosed herein is a method for treating or preventing a disorder associated with expression of beta thalassemia-associated polynucleotide sequences in a subject, the method comprising (a) altering target beta thalassemia-associated polynucleotide sequences in a cell ex vivo by contacting the beta thalassemia-associated polynucleotide sequences in a cell selected from the group consisting of a human pluripotent cell, a primary human cell, and a non-transformed human cell, with a clustered regularly interspaced short palindromic repeats-associated (Cas) protein and multiple ribonucleic acids, wherein the ribonucleic acids direct Cas protein to and hybridize to target motifs of the target SCID-associated polynucleotide sequences, wherein the target beta thalassemia-associated polynucleotide sequences are cleaved, and wherein the efficiency of alteration of cells that express Cas protein is from about 8% to about 80%, and (b) introducing the cell into the subject, thereby treating or preventing a disorder associated with expression of the beta thalassemia-associated polynucleotide sequences.

In some aspects, disclosed herein is a composition, comprising at least one ribonucleic acid having a sequence selected from the group consisting of the ribonucleic acid sequences of FIGS. 1-15 or at least a 12 nucleotide fragment thereof.

In some aspects, disclosed herein is a composition, comprising at least one ribonucleic acid comprising a sequence with a single nucleotide mismatch to a sequence selected from the group consisting of the ribonucleic acid sequences of FIGS. 1-15 or at least a 12 nucleotide fragment thereof.

In some embodiments, the at least one ribonucleic acid is contained in a nanoparticle. In some embodiments, the at least one ribonucleic acid is contained in a lipid nanoparticle. In some embodiments, the lipid nanoparticle comprises at least one of a cationic lipid, a neutral lipid, an amino lipid, a sterol, and a PEG or PEG-modified lipid. In some embodiments, the cationic lipid is selected from the group consisting of ALNY-100, C12-200, DODAC, DDAB, DOTAP, DOTMA, DODMA, DLinDMA, DLenDMA, DLin-C-DAP, DLin-DAC, DLin-MA, DLinDAP, DLin-S-DMA, DLin-2-DMAP, DLin-TMA.Cl, DLin-TAP.Cl, DLin-MPZ, DLinAP, DOAP, DLin-EG-DMA, DLinDMA, DLin-K-DMA, DLin- KC2-DMA, DLin-M-C3-DMA, KC2, MC3, DOTAP.Cl, DOSPA, DOGS, DOPE, DODAP, DMRIE, XTC, and mixtures thereof. In some embodiments, the neutral lipid is selected from the group consisting of DPSC, DPPC, POPC, DOPE, SM, and mixtures thereof. In some embodiments, the PEG-modified lipid is selected from the group consisting of PEG-DMG, PEG-CerC14, PEG-CerC20, and mixtures thereof. In some embodiments, at least one of the ribonucleic acids is a modified ribonucleic acid comprising one to two modified nucleotides selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate.

In some embodiments, a composition further comprises a nucleic acid sequence encoding a Cas protein.

In some embodiments, a composition further comprises a nucleic acid sequence encoding a Cas9 protein or a functional portion thereof. In some embodiments, the nucleic acid comprises a modified ribonucleic acid comprising at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate.

In some aspects, disclosed herein is a composition, comprising a chimeric nucleic acid comprising a ribonucleic acid encoding a Cas protein and at least one additional ribonucleic acid having a sequence selected from the group consisting of the ribonucleic acid sequences of FIGS. 1-15 or at least a 12 nucleotide fragment thereof.

In some aspects, disclosed herein is a composition, comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIGS. 1-15 or at least a 12 nucleotide fragment thereof.

In some embodiments, the composition further comprises a nucleic acid sequence encoding a fluorescent protein selected from the group consisting of green fluorescent protein and red fluorescent protein. In some embodiments, the composition further comprises a promoter operably linked to the chimeric nucleic acid. In some embodiments, the promoter is optimized for increased expression in human stem cells. In some embodiments, the promoter is selected from the group consisting of a Cytomegalovirus (CMV) early enhancer element and a chicken beta-actin promoter, a chicken beta-actin promoter, an elongation factor-1 alpha promoter, and a ubiquitin promoter.

In some embodiments, the chimeric nucleic acid is contained in a nanoparticle. In some embodiments, the chimeric nucleic acid is contained in a lipid nanoparticle. In some embodiments, the lipid nanoparticle comprises at least one of a cationic lipid, a neutral lipid, an amino lipid, a sterol, and a PEG or PEG-modified lipid. In some embodiments, the cationic lipid is selected from the group consisting of ALNY-100, C12-200, DODAC, DDAB, DOTAP, DOTMA, DODMA, DLinDMA, DLenDMA, DLin-C-DAP, DLin-DAC, DLin-MA, DLinDAP, DLin-S-DMA, DLin-2-DMAP, DLin-TMA.Cl, DLin-TAP.Cl, DLin-MPZ, DLinAP, DOAP, DLin-EG-DMA, DLinDMA, DLin-K-DMA, DLin-KC2-DMA, DLin-M-C3-DMA, KC2, MC3, DOTAP.Cl, DOSPA, DOGS, DOPE, DODAP, DMRIE, XTC, and mixtures thereof. In some embodiments, the neutral lipid is selected from the group consisting of DPSC, DPPC, POPC, DOPE, SM, and mixtures thereof. In some embodiments, the PEG-modified lipid is selected from the group consisting of PEG-DMG, PEG-CerC14, PEG-CerC20, and mixtures thereof. In some embodiments, the chimeric nucleic acid comprises at least one modified nucleotide selected from the group consisting of pseudouridine, 5-methylcytodine, 2-thiouridine, 5-methyluridine-5'-triphosphate, 4-thiouridine-5'-triphosphate, 5,6-dihydrouridine-5'-triphosphate, and 5-azauridine-5'-triphosphate.

In some embodiments, the Cas protein comprises a Cas9 protein or a functional portion thereof.

In some aspects, disclosed herein is a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIGS. 1-15, a sequence with a single nucleotide mismatch to a ribonucleic acid sequence of FIGS. 1-15 or at least a 12 nucleotide fragment thereof.

In some embodiments, the kit further comprises one or more cell lines, cultures, or populations selected from the group consisting of human pluripotent cells, primary human cells, and non-transformed cells. In some embodiments, the kit further comprises a DNA repair template selected from the group consisting of an ADA DNA repair template, a AK2 DNA repair template, a CD3D DNA repair template, a DCLRE1C DNA repair template, a IL2RG DNA repair template, IL7R DNA repair template, a JAK3 DNA repair template, a LIG4 DNA repair template, a NHEJ1 DNA repair templates PNP DNA repair template, a PRKDC DNA repair template, a RAG1 DNA repair template, a RAG2 DNA repair template, a ZAP70 DNA repair template, and a HBB DNA repair template.

In some aspects, the disclosure provides a composition comprising at least one ribonucleic acid having a ribonucleic acid sequence of GTAACGGCAGACTTCTCCACAGG (SEQ ID NO: 5321) or at least a 12 nucleotide fragment thereof. In some aspects, the disclosure provides a composition comprising at least one ribonucleic acid comprising a sequence with a single nucleotide mismatch to a ribonucleic acid sequence of GTAACGGCAGACTTCTCCACAGG (SEQ ID NO: 5321) or at least a 12 nucleotide fragment thereof. In some embodiments, the at least one ribonucleic acid is contained in a nanoparticle. In some embodiments, the at least one ribonucleic acid is contained in a lipid nanoparticle. In some embodiments, the lipid nanoparticle comprises at least one of a cationic lipid, a neutral lipid, an amino lipid, a sterol, and a PEG or PEG-modified lipid. In some embodiments, the cationic lipid is selected from the group consisting of ALNY-100, C12-200, DODAC, DDAB, DOTAP, DOTMA, DODMA, DLinDMA, DLenDMA, DLin-C-DAP, DLin-DAC, DLin-MA, DLinDAP, DLin-S-DMA, DLin-2-DMAP, DLin-TMA.Cl, DLin-TAP.Cl, DLin-MPZ, DLinAP, DOAP, DLin-EG-DMA, DLinDMA, DLin-K-DMA, DLin-KC2-DMA, DLin-M-C3-DMA, KC2, MC3, DOTAP.Cl, DOSPA, DOGS, DOPE, DODAP, DMRIE, XTC, and mixtures thereof. In some embodiments, the neutral lipid is selected from the group consisting of DPSC, DPPC, POPC, DOPE, SM, and mixtures thereof. In some embodiments, the PEG-modified lipid is selected from the group consisting of PEG-DMG, PEG-CerC14, PEG-CerC20, and mixtures thereof. In some embodiments, at least one of the ribonucleic acids is a modified ribonucleic acid comprising one to two modified nucleotides selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate. In some embodiments, the composition includes a nucleic acid sequence encoding a Cas protein. In some embodiments, the composition includes a nucleic acid sequence encoding a Cas9 protein or a functional portion thereof. In some embodiments, the nucleic acid comprises a modified ribonucleic acid comprising at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate.

In some aspects, the disclosure provides a composition comprising a chimeric nucleic acid comprising a ribonucleic acid encoding a Cas protein and at least one additional ribonucleic acid having a ribonucleic acid sequences of GTAACGGCAGACTTCTCCACAGG (SEQ ID NO: 5321) or at least a 12 nucleotide fragment thereof. In some aspects, the disclosure provides a composition comprising a chimeric nucleic acid comprising a ribonucleic acid encoding a Cas protein and at least one additional ribonucleic acid sequence comprising a sequence with a single nucleotide mismatch to a ribonucleic acid sequence of GTAACGGCAGACTTCTCCACAGG (SEQ ID NO: 5321) or at least a 12 nucleotide fragment thereof. In some embodiments, the composition includes a nucleic acid sequence encoding a fluorescent protein selected from the group consisting of green fluorescent protein and red fluorescent protein. In some embodiments, the composition includes a promoter operably linked to the chimeric nucleic acid. In some embodiments, the promoter is optimized for increased expression in human stem cells. In some embodiments, the promoter is selected from the group consisting of a Cytomegalovirus (CMV) early enhancer element and a chicken beta-actin promoter, a chicken beta-actin promoter, an elongation factor-1 alpha promoter, and a ubiquitin promoter. In some embodiments, the chimeric nucleic acid is contained in a nanoparticle. In some embodiments, the chimeric nucleic acid is contained in a lipid nanoparticle. In some embodiments, the lipid nanoparticle comprises at least one of a cationic lipid, a neutral lipid, an amino lipid, a sterol, and a PEG or PEG-modified lipid. In some embodiments, the cationic lipid is selected from the group consisting of ALNY-100, C12-200, DODAC, DDAB, DOTAP, DOTMA, DODMA, DLinDMA, DLenDMA, DLin-C-DAP, DLin-DAC, DLin-MA, DLin-DAP, DLin-S-DMA, DLin-2-DMAP, DLin-TMA.Cl, DLin-TAP.Cl, DLin-MPZ, DLinAP, DOAP, DLin-EG-DMA, DLinDMA, DLin-K-DMA, DLin-KC2-DMA, DLin-M-C3-DMA, KC2, MC3, DOTAP.Cl, DOSPA, DOGS, DOPE, DODAP, DMRIE, XTC, and mixtures thereof. In some embodiments, the neutral lipid is selected from the group consisting of DPSC, DPPC, POPC, DOPE, SM, and mixtures thereof. In some embodiments, the PEG-modified lipid is selected from the group consisting of PEG-DMG, PEG-CerC14, PEG-CerC20, and mixtures thereof. In some embodiments, the chimeric nucleic acid comprises at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate. In some embodiments, the Cas protein comprises a Cas9 protein or a functional portion thereof.

In some aspects, the disclosure provides a kit for altering a target polynucleotide sequence in a cell comprising a Cas9 protein or a nucleic acid encoding the Cas9 protein, and at least one ribonucleic acid sequence selected from the group consisting of the ribonucleic acid sequences of GTAACGGCAGACTTCTCCACAGG (SEQ ID NO: 5321), a sequence with a single nucleotide mismatch to a ribonucleic acid sequence of GTAACGGCAGACTTCTCCACAGG (SEQ ID NO: 5321) or at least a 12 nucleotide fragment thereof. In some embodiments, the kit includes one or more cell lines, cultures, or populations selected from the group consisting of human pluripotent cells, primary human cells, and non-transformed cells. In some embodiments, the kit includes a HBB DNA repair template.

BRIEF DESCRIPTION OF THE DRAWINGS

FIG. 1 shows exemplary guide RNA sequences useful when the target polynucleotide sequence is human ADA.

FIG. 2 shows exemplary guide RNA sequences useful when the target polynucleotide sequence is human AK2.

FIG. 3 shows exemplary guide RNA sequences useful when the target polynucleotide sequence is human CD3D.

FIG. 4 shows exemplary guide RNA sequences useful when the target polynucleotide sequence is human DCLRE1C.

FIG. 5 shows exemplary guide RNA sequences useful when the target polynucleotide sequence is human HBB.

FIG. 6 shows exemplary guide RNA sequences useful when the target polynucleotide sequence is human IL2RG.

FIG. 7 shows exemplary guide RNA sequences useful when the target polynucleotide sequence is human IL7R.

FIG. 8 shows exemplary guide RNA sequences useful when the target polynucleotide sequence is human JAK3.

FIG. 9 shows exemplary guide RNA sequences useful when the target polynucleotide sequence is human LIG4.

FIG. 10 shows exemplary guide RNA sequences useful when the target polynucleotide sequence is human NHEJ1.

FIG. 11 shows exemplary guide RNA sequences useful when the target polynucleotide sequence is human PNP.

FIG. 12 shows exemplary guide RNA sequences useful when the target polynucleotide sequence is human PRKDC.

FIG. 13 shows exemplary guide RNA sequences useful when the target polynucleotide sequence is human RAG1.

FIG. 14 shows exemplary guide RNA sequences useful when the target polynucleotide sequence is human RAG2.

FIG. 15 shows exemplary guide RNA sequences useful when the target polynucleotide sequence is human ZAP70.

FIG. 16 shows an exemplary amino acid sequence of a Cas protein. Yellow highlights indicate Ruv-C-like domain. Underlining indicates HNH nuclease domain.

FIGS. 17A, 17B, 17C and 17D demonstrate targeted capture and extremely deep sequencing of on-target and predicted off-target sites in CD34+HPSCs. FIG. 17A is a schematic overview of targeted capture and deep sequencing of on-target and predicted off-target sites (red bar). A 500 bp flanking cutting site (in yellow) were included in sequence analysis for detection of structural rearrangements, including translocations. Probe sets are indicated in blue. FIG. 17B features plots showing consistent sequencing depth coverage at both on-target (left panel) and off-target (right panel) sites, achieving a coverage exceeding 3,000× for all on-target sites. Decrease in sequencing depth at the on-target sites in dual-gRNA libraries is marked by arrow, supporting predicted deletions (bottom left; i=35 bp, ii=205 bp, iii=205 bp). FIG. 17C is a Table depicting the precise estimation of on-target mutation allele frequencies by capture sequencing. Notably, the observed rate of effective null mutation exceeds previous estimates by PCR validation of predictable deletions, as smaller InDels and inversions also occur at appreciable frequencies. FIG. 17D is a Table depicting the estimation of mutation frequencies at predicted off-target sites (*One off-target site was statistically different from controls following correction for multiple comparisons; $p \leq 7.6 \times 10^-$ 11). N-fold enrichment is determined based on the ratio of non-reference reads in treated libraries compared to untreated library. Each value represents the average of all off-target sites for a given single gRNA or dual-gRNA experiment. Enrichment of 1 is equivalent to baseline (untreated control). **For reference to on-target enrichments, on-target combined represents the proportion of non-reference reads (including single and dual-gRNA treatments using a given gRNA) to total reads at on-target sites in treatment compared to control.

FIGS. 18A and 18B demonstrate potential off-target sites identified in CCR5 homologue CCR2 and analysis of events detected at the single off-target site in which mutagenesis was significantly detected above background. FIG. 18A depicts a sequence alignment of CCR5 gRNAs utilized in this study in relation to the closest homologous sequence in CCR2 showing mismatched nucleotides in bold. Noteworthy is the fact that guide crCCR5_B, which yielded the sole significantly detected off-target mutagenesis in CCR2 (detailed in panel B), has 3 nucleotide mismatches, which are distal to the PAM (underlined) and seed (grey box) sequences. FIG. 18B is a Table depicting in-depth analyses of all sequence reads at the single off-target site in which mutagenesis was significantly detected above background in both capture libraries treated with the associated gRNA (B; libraries treated with single gRNA crCCR5_B & dual-gRNA crCCR5_A+B), as well as the library treated with gRNA crCCR5_A as a comparison. Total off-target mutation frequency at this site was 0.6% in the single gRNA treatment (crCCR5_B) and notably decreased to 0.24% in the dual gRNA treatment (crCCR5_A+B) in which gRNA plasmid concentration of each gRNA was half of that utilized in single gRNA treatments.

FIG. 19A is a schematic illustrating the steps employed to generate Fgm knockout mice using the CRISPR/Cas system employing the Cas9 modified RNA. FIG. 19B shows part of a gel picture depicting results from PCR screening of surviving pups for genetic mutations resulting from genomic editing using the CRISPR/Cas system and the modified Cas9 mRNA.

FIG. 20 shows predicted gRNA mapping in Ensembl GRCh37v71.

FIG. 21 shows guide pair crCCR5_A+B on-target alleles.

FIG. 22 shows guide pair crCCR5_C+D on-target alleles.

FIG. 23 shows guide pair crCCR5 D+Q on-target alleles.

FIG. 24 shows off-target sites with statistically significant mutational burden.

FIG. 25 shows a comparison of on- and off-target mutational burdens.

DETAILED DESCRIPTION OF THE INVENTION

Figure 19A:
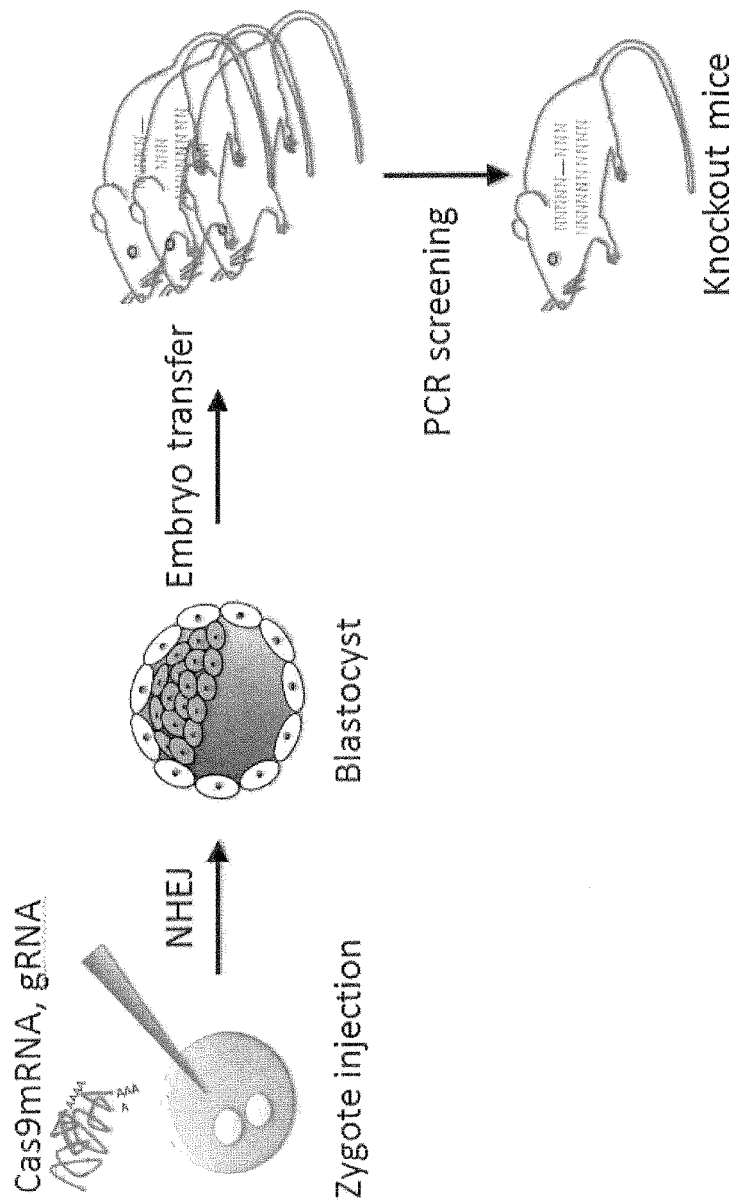
FIGS. 19A and 19B demonstrate the generation of Fgm knockout mice by a CRISPR/Cas system employing a modified Cas9 mRNA.

Work described herein demonstrates methods of allele targeting using CRISPR/Cas systems resulting in mutant cells with efficiencies of up to 80%. These vastly improved methods permit CRISPR/Cas systems to be utilized effectively for the first time for therapeutic purposes. Methods of delivery of CRISPR/Cas systems to human stem cells are provided. In addition, methods of specifically identifying useful RNA guide sequences are provided, along with particular guide sequences useful in targeting specific genes (e.g., ADA, AK2, CD3D, DCLRE1C, HBB, IL2RG, IL7R, JAK3, LIG4, NHEJ1, PNP, PRKDC, RAG1, RAG2, and ZAP70). Moreover, methods of treatment (e.g., methods of treating severe combined immunodeficiency, sickle cell disease, and beta thalassemia) utilizing the compositions and methods disclosed herein are provided.

In one aspect, the present invention provides methods for altering target polynucleotide sequences in a cell.

In certain embodiments, the target polynucleotide sequence is a severe combined immunodeficiency (SCID)-associated polynucleotide sequence. In such embodiments, a method for altering a target polynucleotide sequence in a cell comprises a method for altering a target SCID-associated polynucleotide sequence. As used herein, "severe combined immunodeficiency-associated polynucleotide sequence" and "SCID-associated polynucleotide sequence" are used interchangeably to refer to a polynucleotide sequence of a gene displaying one or more mutations associated with SCID. As used herein "severe combined immunodeficiency" and "SCID" refer to a genetic disorder characterized by dysfunctional T-lymphocytes causing a defective antibody response due to either a direct involvement with B lymphocytes or aberrant B lymphocyte activation resulting from non-functional T-helper cells. SCID encompasses dysfunctional B and T cell responses of the adaptive immune system due to mutations in one or more genes, including, but not limited to, ADA, AK2, CD3D, DCLRE1C, IL2RG, IL7R, JAK3, LIG4, NHEJ1, PNP, PRKDC, RAG1, RAG2, and ZAP70. As such, a "SCID-associated polynucleotide sequence" encompasses nucleotide sequences of any of these genes along with variant or mutant forms thereof.

An exemplary method for altering a target severe combined immunodeficiency (SCID)-associated polynucleotide sequence in a cell comprises contacting the SCID-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCID-associated polynucleotide sequence, wherein the target SCID associated polynucleotide sequence is cleaved. In some embodiments, the efficiency of alteration of cells that express Cas protein is from about 50% to about 80%.

In some embodiments, the SCID-associated polynucleotide sequence is adenosine deaminase (ADA) or a variant thereof. An exemplary ADA sequence is a human ADA sequence (NCBI Gene ID: 100). Those skilled in the art will appreciate that the guide sequences shown in FIG. 1 can be used with the CRISPR/Cas systems of the present invention to alter target polynucleotide sequences of human ADA.

It should also be appreciated that altering a target polynucleotide sequence of ADA can be used to treat any abnormal phenotype associated with an altered ADA polynucleotide sequence. Table 1 below shows gene phenotype relationships identified by the Online Mendelian Inheritance in Man® (OMIM®) database. Further information regarding a phenotype listed in Table 1 is publicly accessible by querying OMIM for the search term "ADA" and then clicking on a hyperlink in the "Phenotype MIM number" column corresponding to the phenotype listed.

TABLE 1

ADA Gene Phenotype Relationships

| Location | Phenotype | Phenotype MIM number |
| --- | --- | --- |
| 20q13.12 | Adenosine deaminase deficiency, partial | 102700 |
|  | Severe combined immunodeficiency due to ADA deficiency | 102700 |

In some embodiments, the SCID-associated polynucleotide sequence is adenylate kinase 2 (AK2) or a variant thereof. An exemplary AK2 sequence is a human AK2 sequence (NCBI Gene ID: 204, also known as ADK2 and AK 2). In some embodiments, the human AK2 sequence comprises all or a portion of AK2 coding sequence 1. In some embodiments, the human AK2 sequence comprises all or a portion of AK2 coding sequence 2. In some embodiments, the human AK2 sequence comprises all or a portion of AK2 coding sequence 3. Those skilled in the art will appreciate that the guide sequences shown in FIGS. 2, 3 and 4 can be used with the CRISPR/Cas systems of the present invention to alter target polynucleotide sequences of human AK2, and in particular human AK2 coding sequences 1, 2 and 3, respectively.

It should also be appreciated that altering a target polynucleotide sequence of AK2 can be used to treat any abnormal phenotype associated with an altered AK2 polynucleotide sequence. Table 2 below shows gene phenotype relationships identified by the OMIM® database. Further information regarding a phenotype listed in Table 2 is publicly accessible by querying OMIM for the search term "AK2" and then clicking on a hyperlink in the "Phenotype MIM number" column corresponding to the phenotype listed.

TABLE 2

AK2 Gene Phenotype Relationships

| Location | Phenotype | Phenotype MIM number |
|---|---|---|
| 1p35.1 | Reticular dysgenesis | 267500 |

In some embodiments, the SCID-associated polynucleotide sequence is CD3 antigen, delta subunit (CD3D) or a variant thereof. An exemplary CD3D sequence is a human CD3D sequence (NCBI Gene ID: 915, also known as T3D and CD3-DELTA). In some embodiments, the human CD3D sequence comprises all or a portion of CD3D coding sequence 1. In some embodiments, the human CD3D sequence comprises all or a portion of CD3D coding sequence 2. Those skilled in the art will appreciate that the guide sequences shown in FIGS. 5 and 6 can be used with the CRISPR/Cas systems of the present invention to alter target polynucleotide sequences of human CD3D, and in particular human CD3D coding sequences 1 and 2, respectively.

It should also be appreciated that altering a target polynucleotide sequence of CD3D can be used to treat any abnormal phenotype associated with an altered CD3D polynucleotide sequence. Table 3 below shows gene phenotype relationships identified by the OMIM® database. Further information regarding a phenotype listed in Table 3 is publicly accessible by querying OMIM for the search term "CD3D" and then clicking on a hyperlink in the "Phenotype MIM number" column corresponding to the phenotype listed.

TABLE 3

CD3D Gene Phenotype Relationships

| Location | Phenotype | Phenotype MIM number |
|---|---|---|
| 11q23.3 | Severe combined immunodeficiency, T cell-negative, B-cell/natural killer-cell positive | 608971 |

In some embodiments, the SCID-associated polynucleotide sequence is DNA cross-link repair protein 1C (DCLRE1C) or a variant thereof. An exemplary DCLRE1C sequence is a human DCLREIC sequence (NCBI Gene ID: 64421, also known as SCIDA, SNMIC, A-SCID, hSNM1C, RS-SCID, DCLREIC). In some embodiments, the human DCLREIC sequence comprises all or a portion of DCLRE1C coding sequence 1. In some embodiments, the human DCLREIC sequence comprises all or a portion of DCLREIC coding sequence 2. In some embodiments, the human DCLREIC sequence comprises all or a portion of DCLREIC coding sequence 3. In some embodiments, the human DCLREIC sequence comprises all or a portion of DCLREIC coding sequence 4. Those skilled in the art will appreciate that the guide sequences shown in FIGS. 7, 8, 9, and 10 can be used with the CRISPR/Cas systems of the present invention to alter target polynucleotide sequences of human DCLRE1C, and in particular human DCLRE1C coding sequences 1, 2, 3, and 4, respectively.

It should also be appreciated that altering a target polynucleotide sequence of DCLREIC can be used to treat any abnormal phenotype associated with an altered DCLREIC polynucleotide sequence. Table 4 below shows gene phenotype relationships identified by the OMIM® database. Further information regarding a phenotype listed in Table 4 is publicly accessible by querying OMIM for the search term "DCLREIC" and then clicking on a hyperlink in the "Phenotype MIM number" column corresponding to the phenotype listed.

TABLE 4

DCLRE1C Gene Phenotype Relationships

| Location | Phenotype | Phenotype MIM number |
|---|---|---|
| 10p13 | Omenn syndrome | 603554 |
|  | Severe combined immunodeficiency, Athabascan type | 602450 |

In some embodiments, the SCID-associated polynucleotide sequence is interleukin 2 receptor, gamma (IL2RG) or a variant thereof. An exemplary IL2RG sequence is a human IL2RG sequence (NCBI Gene ID: 3561, also known as P64; CIDX; IMD4; CD132; SCIDX; IL-2RG; and SCIDX1). Those skilled in the art will appreciate that the guide sequences shown in FIG. 12 can be used with the CRISPR/Cas systems of the present invention to alter target polynucleotide sequences of human IL2RG.

It should also be appreciated that altering a target polynucleotide sequence of IL2RG can be used to treat any abnormal phenotype associated with an altered IL2RG polynucleotide sequence. Table 5 below shows gene phenotype relationships identified by the OMIM® database. Further information regarding a phenotype listed in Table 5 is publicly accessible by querying OMIM for the search term "IL2RG" and then clicking on a hyperlink in the "Phenotype MIM number" column corresponding to the phenotype listed.

TABLE 5

IL2RG Gene Phenotype Relationships

| Location | Phenotype | Phenotype MIM number |
|---|---|---|
| Xq13.1 | Combined immunodeficiency, X-linked, moderate | 312863 |
|  | Severe combined immunodeficiency, X-linked | 300400 |

In some embodiments, the SCID-associated polynucleotide sequence is interleukin 7 receptor (IL7R) or a variant thereof. An exemplary IL7R sequence is a human IL7R sequence (NCBI Gene ID: 3575, also known as ILRA, CD127, IL7RA, CDW127, IL-7R-alpha). Those skilled in the art will appreciate that the guide sequences shown in FIG. 13 can be used with the CRISPR/Cas systems of the present invention to alter target polynucleotide sequences of human IL7R.

It should also be appreciated that altering a target polynucleotide sequence of IL7R can be used to treat any abnormal phenotype associated with an altered IL7R polynucleotide sequence. Table 6 below shows gene phenotype relationships identified by the OMIM® database. Further information regarding a phenotype listed in Table 6 is publicly accessible by querying OMIM for the search term "IL7R" and then clicking on a hyperlink in the "Phenotype MIM number" column corresponding to the phenotype listed.

TABLE 6

IL7R Gene Phenotype Relationships

| Location | Phenotype | Phenotype MIM number |
|---|---|---|
| 5p13.2 | Severe combined immunodeficiency, T-cell negative, B-cell/natural killer cell-positive type | 608971 |

In some embodiments, the SCID-associated polynucleotide sequence is Janus kinase 3(JAK3) or a variant thereof. An exemplary JAK3 sequence is a human JAK3 sequence (NCBI Gene ID: 3718, also known as JAKL; LJAK; JAK-3; L-JAK; JAK3_HUMAN). Those skilled in the art will appreciate that the guide sequences shown in FIG. 14 can be used with the CRISPR/Cas systems of the present invention to alter target polynucleotide sequences of human JAK3.

It should also be appreciated that altering a target polynucleotide sequence of JAK3 can be used to treat any abnormal phenotype associated with an altered JAK3 polynucleotide sequence. Table 7 below shows gene phenotype relationships identified by the OMIM® database. Further information regarding a phenotype listed in Table 7 is publicly available by querying OMIM for the search term "JAK3" and then clicking on a hyperlink in the "Phenotype MIM number" column corresponding to the phenotype listed.

TABLE 7

JAK3 Gene Phenotype Relationships

| Location | Phenotype | Phenotype MIM number |
|---|---|---|
| 19p13.11 | SCID, autosomal recessive, T-negative/B-positive type | 600802 |

In some embodiments, the SCID-associated polynucleotide sequence is ligase IV, DNA, ATP-dependent (LIG4) or a variant thereof. An exemplary LIG4 sequence is a human LIG4 sequence (NCBI Gene ID: 3981). In some embodiments, the human LIG4 sequence comprises all or a portion of LIG4 coding sequence 1. In some embodiments, the human LIG4 sequence comprises all or a portion of LIG4 coding sequence 2. In some embodiments, the human LIG4 sequence comprises all or a portion of LIG4 coding sequence 3. Those skilled in the art will appreciate that the guide sequences shown in FIGS. 15, 16, and 17 can be used with the CRISPR/Cas systems of the present invention to alter target polynucleotide sequences of human LIG4, and in particular human LIG4 coding sequences 1, 2, and 3, respectively.

It should also be appreciated that altering a target polynucleotide sequence of LIG4 can be used to treat any abnormal phenotype associated with an altered LIG4 polynucleotide sequence. Table 8 below shows gene phenotype relationships identified by the OMIM® database. Further information regarding a phenotype listed in Table 8 is publicly accessible by querying OMIM for the search term "LIG4" and then clicking on a hyperlink in the "Phenotype MIM number" column corresponding to the phenotype listed.

TABLE 8

LIG4 Gene Phenotype Relationships

| Location | Phenotype | Phenotype MIM number |
|---|---|---|
| 13q33.3 | LIG4 syndrome | 606593 |
| | Severe combined immunodeficiency with sensitivity to ionizing radiation | 602450 |
| | {Multiple myeloma, resistance to} | 254500 |

In some embodiments, the SCID-associated polynucleotide sequence is nonhomologous end-joining factor 1 (NHEJ1) or a variant thereof. An exemplary NHEJ1 sequence is the human NHEJ1 sequence (NCBI Gene ID: 79840, also known as XLF). Those skilled in the art will appreciate that the guide sequences shown in FIG. 18 can be used with the CRISPR/Cas systems of the present invention to alter target polynucleotide sequences of human NHEJ1.

It should also be appreciated that altering a target polynucleotide sequence of NHEJ1 can be used to treat any abnormal phenotype associated with an altered NHEJ1 polynucleotide sequence. Table 9 below shows gene phenotype relationships identified by the OMIM® database. Further information regarding a phenotype listed in Table 9 is publicly accessible by querying OMIM for the search term "NHEJ1" and then clicking on a hyperlink in the "Phenotype MIM number" column corresponding to the phenotype listed.)

TABLE 9

NHEJ1 Gene Phenotype Relationships

| Location | Phenotype | Phenotype MIM number |
|---|---|---|
| 2q35 | Severe combined immunodeficiency with microcephaly, growth retardation, and sensitivity to ionizing radiation | 611291 |

In some embodiments, the SCID-associated polynucleotide sequence is a purine nucleoside phosphorylase sequence (PNP) or a variant thereof. An exemplary PNP sequence is human PNP (NCBI Gene ID: 4860, also known as NP, PUNP, and PRO1837). Those skilled in the art will appreciate that the guide sequences shown in FIG. 19 can be used with the CRISPR/Cas systems of the present invention to alter target polynucleotide sequences of human PNP.

It should also be appreciated that altering a target polynucleotide sequence of PNP can be used to treat any abnormal phenotype associated with an altered PNP polynucleotide sequence. Table 10 below shows gene phenotype relationships identified by the OMIM® database. Further information regarding a phenotype listed in Table 10 is publicly accessible by querying OMIM for the search term "PNP" and then clicking on a hyperlink in the "Phenotype MIM number" column corresponding to the phenotype listed.

TABLE 10

PNP Gene Phenotype Relationships

| Location | Phenotype | Phenotype MIM number |
|---|---|---|
| 14q11.2 | Immunodeficiency due to purine nucleoside phosphorylase deficiency | 613179 |

In some embodiments, the SCID-associated polynucleotide sequence is a protein kinase, DNA activated, catalytic polypeptide sequence (PRKDC) or a variant thereof. An exemplary PRKDC sequence is human PRKDC (NCBI Gene ID: 5591, also known as HYRC; p350; DNAPK; DNPK1; HYRC1; XRCC7; and DNA-PKcs). In some embodiments, the human PRKDC sequence comprises all or a portion of PRKDC coding sequence 1. In some embodiments, the human PRKDC sequence comprises all or a portion of PRKDC coding sequence 2. Those skilled in the art will appreciate that the guide sequences shown in FIGS. 20 and 21 can be used with the CRISPR/Cas systems of the present invention to alter target polynucleotide sequences of human PRKDC, and in particular human PRKDC coding sequences 1 and 2, respectively.

It should also be appreciated that altering a target polynucleotide sequence of PRKDC can be used to treat any abnormal phenotype associated with an altered PRKDC polynucleotide sequence. In some embodiments, the phenotype associated with an altered PRKDC polynucleotide sequence is SCID. In some embodiments, the phenotype associated with an altered PRKDC polynucleotide sequence is radiosensitivity in xeroderma pigmentosum (Abbaszadeh et al., A novel splice variant of the DNA-PKcs gene is associated with clinical and cellular radiosensitivity in a patient with xeroderma pigmentosum. J Med Genet. 2010; 47(3):176-81).

In some embodiments, the SCID-associated polynucleotide sequence is a recombination activating gene 1 sequence (RAG1) or a variant thereof. An exemplary RAG1 sequence is human RAG1 (NCBI Gene ID: 5896, also known as RAG-1 and RNF74). Those skilled in the art will appreciate that the guide sequences shown in FIG. 22 can be used with the CRISPR/Cas systems of the present invention to alter target polynucleotide sequences of human RAG1.

It should also be appreciated that altering a target polynucleotide sequence of RAG1 can be used to treat any abnormal phenotype associated with an altered RAG1 polynucleotide sequence. Table 11 below shows gene phenotype relationships identified by the OMIM® database. Further information regarding a phenotype listed in Table 11 is publicly accessible by querying OMIM for the search term "RAG1" and then clicking on a hyperlink in the "Phenotype MIM number" column corresponding to the phenotype listed.

TABLE 11

RAG1 Gene Phenotype Relationships

| Location | Phenotype | Phenotype MIM number |
|---|---|---|
| 11p12 | Alpha/beta T-cell lymphopenia with gamma/delta T-cell expansion, severe cytomegalovirus infection, and autoimmunity | 609889 |
| | Combined cellular and humoral immune defects with granulomas | 233650 |
| | Omenn syndrome | 603554 |
| | Severe combined immunodeficiency, B cell-negative | 601457 |

In some embodiments, the SCID-associated polynucleotide sequence is a recombination activating gene 2 sequence (RAG2) or a variant thereof. An exemplary RAG2 sequence is human RAG2 (NCBI Gene ID: 5897, also known as RAG-2). In some embodiments, the human RAG2 sequence comprises all or a portion of human RAG2 coding sequence 1. In some embodiments, the human RAG2 sequence comprises all or a portion of human RAG2 coding sequence 2. In some embodiments, the human RAG2 sequence comprises all or a portion of human RAG2 coding sequence 3. Those skilled in the art will appreciate that the guide sequences shown in FIGS. 23, 24 and 25 can be used with the CRISPR/Cas systems of the present invention to alter target polynucleotide sequences of human RAG2, and in particular human RAG2 coding sequences 1, 2 and 3, respectively.

It should also be appreciated that altering a target polynucleotide sequence of RAG2 can be used to treat any abnormal phenotype associated with an altered RAG2 polynucleotide sequence. Table 12 below shows gene phenotype relationships identified by the OMIM® database. Further information regarding a phenotype listed in Table 12 is publicly accessible by querying OMIM for the search term "RAG2" and then clicking on a hyperlink in the "Phenotype MIM number" column corresponding to the phenotype listed.

TABLE 12

RAG2 Gene Phenotype Relationships

| Location | Phenotype | Phenotype MIM number |
|---|---|---|
| 11p12 | Combined cellular and humoral immune defects with granulomas | 233650 |
| | Omenn syndrome | 603554 |
| | Severe combined immunodeficiency, B cell-negative | 601457 |

In some embodiments, the SCID-associated polynucleotide sequence is a zeta-chain-associated protein kinase sequence (ZAP70) or a variant thereof. An exemplary ZAP70 sequence is human ZAP70 (NCBI Gene ID: 7535, also known as SRK; STD; TZK; STCD; and ZAP-70). In some embodiments, the human ZAP70 sequence comprises all or a portion of human ZAP70 coding sequence 1. In some embodiments, the human ZAP70 sequence comprises all or a portion of human ZAP70 coding sequence 2. Those skilled in the art will appreciate that the guide sequences shown in FIGS. 26 and 27 can be used with the CRISPR/Cas systems of the present invention to alter target polynucleotide sequences of human ZAP70, and in particular human ZAP70 coding sequences 1 and 2, respectively.

It should also be appreciated that altering a target polynucleotide sequence of ZAP70 can be used to treat any abnormal phenotype associated with an altered ZAP70 polynucleotide sequence. Table 13 below shows gene phenotype relationships identified by the OMIM® database. Further information regarding a phenotype listed in Table 13 is publicly accessible by querying OMIM for the search term "ZAP70" and then clicking on a hyperlink in the "Phenotype MIM number" column corresponding to the phenotype listed.

TABLE 13

ZAP 70 Gene Phenotype Relationships

| Location | Phenotype | Phenotype MM number |
|---|---|---|
| 2q11.2 | Selective T-cell defect | 269840 |

In some embodiments, the target polynucleotide sequence is hemoglobin beta ("HBB") (e.g., human hemoglobin beta, NCBI Gene ID: 3043) or a variant thereof. Those skilled in the art will appreciate that the guide sequences shown in FIG. 11 can be used with the CRISPR/Cas systems of the present invention to alter target polynucleotide sequences of human HBB.

It should also be appreciated that altering a target polynucleotide sequence of HBB can be used to treat any abnormal phenotype associated with an altered HBB polynucleotide sequence. Table 14 below shows gene phenotype relationships as identified by the OMIM® database. Further information regarding a phenotype listed in Table 14 is publicly accessible by querying OMIM for the search term "HBB" and then clicking on a hyperlink in the "Phenotype MIM number" column corresponding to the phenotype listed.

TABLE 14

HBB Gene Phenotype Relationships

| Location | Phenotype | Phenotype MIM number |
|---|---|---|
| 11p15.4 | Delta-beta thalassemia | 141749 |
| | Erythremias, beta- | |
| | Heinz body anemias, beta- | 140700 |
| | Hereditary persistence of fetal hemoglobin | 141749 |
| | Methemoglobinemias, beta- | |
| | Sickle cell anemia | 603903 |
| | Thalassemia-beta, dominant inclusion-body | 603902 |
| | Thalassemias, beta- | 613985 |
| | {Malaria, resistance to} | 611162 |

Normal adult hemoglobin is a tetramer that consists of two alpha chains and two beta chains. HBB determines the structure of the beta chains of hemoglobin. HBB mutations are associated with sickle cell diseases and/or beta thalassemia. For example, sickle cell anemia is caused by mutant beta globin. The absence of the beta chain results in beta-zero thalassemia. Diminished amounts of detectable beta globin results in beta-plus-thalassemia. Exemplary mutant forms of HBB involved in sickle cell disease are Hemoglobin S (Glu6Val), Hemoglobin C (Glu6Lys), Hemoglobin D and Hemoglobin O (Glu121Lys).

Insertion of an L1 retrotransposable fragment within the IVS-II of the beta-globin gene results in beta°-thal. This represents a form of beta thalassemia in which the beta globin gene expresses full length beta-globin transcripts at levels equal to about 15% of the total beta-globin mRNA.

In some embodiments, a method for altering a target polynucleotide sequence in a cell comprises a method for altering a target sickle cell disease (SCD)-associated polynucleotide sequence. As used herein, "sickle cell disease-associated polynucleotide sequence" or "SCD-associated polynucleotide sequence" are used interchangeably to refer to a polynucleotide sequence of the HBB gene displaying one or more HBB mutations associated with SCD. As used herein, "sickle cell disease" refers to a group of symptomatic disorders involving mutations in HBB and defined by the presence of hemoglobin S (Hb S). Normal hemoglobin is a heterotetramer consisting of two alpha-hemoglobin and two beta-hemoglobin chains. Point mutations in HBB cause hemoglobin S to result, for example a point mutation changing the sixth amino acid in the beta-hemoglobin chain from glutamic acid to valine (Glu6Val). Sickle cell anemia (homogzygous HbSS) is an example of a sickle cell disease which makes up between 60-70% of reported sickle cell disease in the United States. Examples of other forms of sickle cell disease are due to coinhereitance of Hb S with various mutant beta-globin chain variants, including sickle-hemoglobin C disease (Hb SC), and two different types of sickle beta thalassemia (Hb Sβ$^+$. thalassemia and Hb S β°. thalassemia).

An exemplary method for altering a target sickle cell disease (SCD)-associated polynucleotide sequence in a cell comprises contacting the SCD-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCD-associated polynucleotide sequence, wherein the target SCD-associated polynucleotide sequence is cleaved. In some embodiments of this and other aspects, the efficiency of alteration of cells that express Cas protein is from about 50% to about 80%.

In some embodiments, a method for altering a target polynucleotide sequence in a cell comprises a method for altering a target beta thalassemia-associated polynucleotide sequence. As used herein, "beta thalassemia-associated polynucleotide sequence" refers to a polynucleotide sequence of the HBB gene displaying one or more HBB mutations associated with beta thalassemia. As used herein, "beta thalassemia" refers to inherited autosomal recessive diseases characterized by decreased production of the hemoglobin subunit beta (e.g., hemoglobin beta chain) that are caused by over 200 different HBB mutations. As will be appreciated by the skilled artisan, HBB mutations resulting in beta thalassemia include non-deletional HBB mutants, deletional HBB mutants, and HBB mutants resulting from transposable elements. Table 15 below illustrates exemplary non-deletional HBB mutations.

TABLE 15

Non-deletional HBB mutations associated with beta thalassemia

−101 (C−>T)
−92 (C−>T)
−90 (C−>T)
−88 (C−>A)
−88 (C−>T)
−87 (C−>A)
−87 (C−>G)
−87 (C−>T)
−86 (C−>A)

TABLE 15-continued

Non-deletional HBB mutations associated with beta thalassemia

−86 (C−>G)
−32 (C−>A)
−31 (A−>C)
−31 (A−>G)
−30 (T−>A)
−30 (T−>C)
−29 (A−>G)
−28 (A−>C)
−28 (A−>G)
CAP +1 (A−>C)
5′UTR; +10 (−T)
5′UTR; +22 (G−>A)
5′UTR; +33 (C−>G)
5′UTR; +43 to +40 (−AAAC)
Initiation codon A*T*G−>*G*TG
Initiation codon A*T*G−>A*C*G
Initiation codon A*T*G−>A*G*G
Initiation codon AT*G*−>AT*A*
Initiation codon AT*G*−>AT*C*
Initiation codon AT*G*−>AT*T*
Codon 1 (−G); GTG(Val)−>-TG
Codons 2/3/4 (−9 bp; +31 bp); (see below)
Codon 5 (−CT); CCT(Pro)−>C--
Codon 6 (−A); GAG(Glu)−>G-G
Codon 8 (−AA); AAG(Lys)−>--G
Codons 8/9 (+G); AAG•TCT(Lys;Ser)−>AAG•G•TCT
Codons 9/10 (+T); TCT•GCC(Ser;Ala)−>TCT•T•GCC
Codon 10 (C−>A); GCC(Ala)−>GCA(Ala)
Codon 11 (−T); GTT(Val)−>GT-
Codons 14/15 (+G);
Codon 15 (G−>A); TGG(Trp)−>TAG(stop codon)
Codon 15 (G−>A); TGG(Trp)−>TGA(stop codon)
Codon 15 (−T); TGG(Trp)−>-GG
Codon 16 (−C); GGC(Gly)−>GG-
Codon 17 (A−>T); AAG(Lys)−>TAG(stop codon)
Codon 19 (A−>G); AAC(Asn)−>AGC(Ser)
Codon 22 (A−>C); G*A*A(Glu)−>GCA(Ala) (not listed in Table I; this mutation is likely not associated with thalassemia)
Codon 22 (G−>T); GAA(Glu)−>TAA(stop codon)
Codons 22/23/24 (GAA•GTT•GGT; Glu•Val•Gly); deletion of −AAGTTGG
Codon 24; GGT(Gly); (−G; +CAC)
Codon 24 (T−>A); GGT(Gly)−>GGA(Gly)
Codons 24/25 (−GGT); GGT•GGT(Gly-Gly)−>---•GGT(Gly)
Codons 25/26 (+T); GGT•GAG(Gly-Glu)−>GGT•T•GAG(Gly-Term)
Codon 26 (*G*AG−>*A*AG)
Codon 26 (G−>T); GAG(Glu)−>TAG(stop codon)
Codon 26 (+T); GAG(Glu)−>GTAG
Codon 27 (G−>T); GCC(Ala)−>TCC(Ser)
Codons 27/28 (+C); GCC•CTG(Ala•Ser)−>GCC•C•CTG
Codon 28 (−C); CTG(Leu)−>-TG
Codon 28 (T−>G); CTG(Leu)−>CGG(Arg)
Codons 28/29 (−G); CTG•GGC(Leu•Gly)−>CTG•-GC
IVS-I (−3) or codon 29 (C−>T); GGC(Gly)−>GGT(Gly)
IVS-I (−2) or codon 30 (A−>G); *AG*ˆGTTGGT−>*GG*ˆGTTGGT
IVS-I (−1) or codon 30 (G−>A); *AG*ˆGTTGGT−>*AA*ˆGTTGGT
IVS-I (−1) or codon 30 (G−>C); *AG*ˆGTTGGT−>*AC*ˆGTTGGT
IVS-I-1 (G−>A); AGˆ*G*TTGGT−>AGˆ*A*TTGGT
IVS-I-1 (G−>T); AGˆ*G*TTGGT−>AGˆ*T*TTGGT
IVS-I-2 (T−>A); AGˆG*T*TGGT−>AGGˆ*A*TGGT
IVS-I-2 (T−>C); AGˆG*T*TGGT−>AGA*C*TGGT
IVS-I-2 (T−>G); AGˆG*T*TGGT−>AGG*G*TGGT
IVS-I-5 (G−>A)
IVS-I-5 (G−>A) plus the 7,201 bp deletion involving part of the delta gene; the Corfu deletion (deltabeta-thal)
IVS-I-5 (G−>C)
IVS-I-5 (G−>T)
IVS-I-6 (T−>C); the Portuguese type
IVS-I-110 (G−>A)
IVS-I-116 (T−>G)
IVS-I-128 (T−>G); TTAGˆGCTG−>TGAGˆGCTG
IVS-I-130 (G−>A); TTAGˆGCTG−>TTAA GCTG
IVS-I-130 (G−>C); TTAGˆGCTG−>TTAC GCTG
Codon 30 (AG*G*−>AG*C*) [IVS-I-130 (+1)]
IVS-I, 3′ end; −17 bp
Codon 31 (−C); CTG−>-TG
Codons 31/32 (+CGG)
Codon 32 (T−>A) C*T*G−>C*A*G; codon 98 (G−>A) GTG−>*A*TG TABLE 15-continued Non-deletional HBB mutations associated with beta thalassemia Codons 33/34 (−GTG); GTG•GTC(Val-Val)−>GTC•---(Val)
Codon 35 (C−>A); TAC−>TAA (Tyr−>Term codon)
Codon 35 (−C); TAC(Tyr)−>TA-
Codons 36/37 (−T); CCT•TGG(Pro-Trp)−>CCT•-GG
Codon 37 (G−>A); TGG(Trp)−>TGA(stop codon)
Codons 37/38/39 (−7 nts)
Codons 38/39 (−C); ACC•CAG(Thr•Gln)−>ACC•-AG
Codons 38/39 (−CC); ACC•CAG(Thr-Glu)−>A--•CAG
Codon 39 (C−>T); CAG(Gln)−>TAG(stop codon)
Codon 40 (−G); AGG(Arg)−>AG-
Codons 40/41 (+T); AGG•TTC(Arg-Phe)−>AGG•T•TTC
Codon 41 (−C); TTC(Phe)−>TT-
Codons 41/42 (−TTCT); TTC•TTT(Phe-Phe)−>--- -TT
Codons 42/43 (+G); TTT•GAG(Phe•Glu)−>TTT•G•GAG
Codons 42/43 (+T) TTT•GAG(Phe•Glu)−>TTT•TGA•G(Phe;stop codon)
Codon 43 (G−>T); GAG(Glu)−>TAG (stop codon)
Codon 44 (−C); TCC(Ser)−>TC-
Codon 45 (−T); TTT(Phe)−>-TT
Codon 47 (+A); GAT(Asp)−>GAA(Glu)•T
Codons 47/48 (+ATCT); GAT•CTG(Asp-Leu)−>GAT•CT*ATCT*G
Codon 51 (−C); CCT(Pro)−>-CT
53/54 (+G); GCT•GTT(Ala-Val)−>GCT•G•GTT
Codon 54 (−T); GTT(Val)−>GT-
Codons 54/55 (+A); GTT•ATG(Val•Met)−>GTT•A•ATG
Codons 56/57/58/59/60 (GGC•AAC•CCT•AAG•GTG) (SEQ ID NO: 5345); duplication of 14 bp
Codons 57/58 (+C); AAC•CCT(Asn•Pro)−>AAC•C•CCT
Codon 59 (−A); AAG(Lys)−>-AG
Codon 60 (T−>A); GTG(Val)−>GAG(Glu)
Codon 61 (A−>T); AAG(Lys)−>TAG(stop codon)
Codon 64 (−G); GGC(Gly)−>-GC
Codon 67 (−TG); GTG(Val)−>--G
Codons 71/72 (+A); TTT•AGT(Phe•Ser)−>TTT•A•AGT
Codons 71/72 (+T); TTT•AGT(Phe•Ser)−>TTT•T•AGT
Codons 72/73; −AGTGA, +T; AGT•GAT(Ser-Asp)−>--- -TT
Codons 74/75 (−C); GGC•CTG(Gly•Leu)−>GG- •CTG
Codon 76 (−C); GCT(Ala)−>G-T
Codons 82/83 (−G); AAG•GGC(Lys•Gly)−>AAG•-GC
Codons 84/85 (+C); ACC•TTT(Thr•Phe)−>ACC•C•TTT
Codons 84/85/86 (+T); ACC•TTT•GCC(Thr•Phe•Ala)−>ACC•TTT•T•GCC
Codon 88 (+T); CTG(Leu)−>CTTG
Codons 89/90 (−GT); AGT•GAG(Ser•Glu)−>A--•GAG
Codon 90 (G−>T); GAG(Glu)−>TAG(stop codon)
Codon 94 (+TG); GAC(Asp)−>G*TG*AC
Codon 95 (+A); AAG(Lys)−>AAAG
Codon 100; -CTT, +TCTGAGAACTT
IVS-II-1 (G−>A);
IVS-II-1 (G−>C);
IVS-II-2,3 (+11, −2); insertion of 11 bp (5′-ACGTTCT CTGA-3′) (SEQ ID NO: 5346) and deletion of GA (nts 2 and 3 of IVS-II) between positions 1 and 4 of IVS-II
IVS-II-4,5 (−AG);
IVS-II-5 (G−>C)
IVS-II-654 (C−>T); AAGG*C*AATA−>AAGˆ*GT*AATA
IVS-II-705 (T−>G); GA*T*GTAAGA−>GAGˆGTAAGA
IVS-II-745 (C−>G); CAG*C*TACCAT−>CAGˆGTACCAT
IVS-II-837 (T−>G);
IVS-II-843 (T−>G);
IVS-II-844 (C−>G);
IVS-II-848 (C−>A);
IVS-II-848 (C−>G);
IVS-II-849 (A−>C);
IVS-II-849 (A−>G);
IVS-II-850 (−G);
IVS-II-850 (G−>A);
IVS-II-850 (G−>C);
IVS-II-850 (G−>T);
Codons 106/107 (+G); CTG•GGC(Leu•Gly)−>CTG•G•GC
Codons 108/109/110/111/112 (−12 bp);
Codon 109 (−G); GTG(Val)−>TG
Codon 110 (T−>C); CTG(Leu)−>CCG(Pro)
Codon 112 (T−>A); TGT(Cys)−>TGA(stop codon)
Codon 114 (T−>C); CTG(Leu)−>CCG(Pro)
Codon 114 (−CT; +G); CTG(Leu)−>-GG
Codon 115 (C−>A); GCC(Ala)−>GAC(Asp)
Codons 120/121 (+A); AAA•GAA(Lys-Glu)−>AAA•*A*•GAA
Codon 121 (G−>T); GAA(Glu)−>TAA(stop codon)

TABLE 15-continued

Non-deletional HBB mutations associated with beta thalassemia

Codon 123 (–A); ACC(Thr)–>-CC
Codons 123/124/125 (–ACCCCACC);
ACC•CCA•CCA(Thr•Pro•Pro)–>--- --- --A
Codon 124 (–A); CCA(Pro)–>CC-
Codon 125 (–A); CCA(Pro)–>CC-
Codons 124/125/126 (+CCA); CCA•CCA•GTG(Pro•Pro•Val)
(SEQ ID NO: 5347) ->CCA•CCA•CCA•GTG (Pro•Pro•Pro•Val)
(SEQ ID NO: 5348)
Codon 126 (–T); GTG(Val)–>G-G
Codon 126 (T–>G); GTG(Val)–>GGG(Gly)
Codons 126-131 (Val-Gln-Ala-Ala-Thr-Gln (SEQ ID NO: 5349)) (–17
bp); G*TG•CAG•GCT•GCC•TAT•CAG* (SEQ ID NO: 5350) ->G
Codon 127 (A–>C); CAG(Gln)–>CCG(Pro)
Codon 127 (A–>G); CAG(Gln)–>CGG(Arg)
Codon 127 (C–>T); CAG(Gln)–>TAG(stop codon)
Codons 127/128 (–AGG); CAG•GCT(Gln•Ala)–>C-- -CT(Pro)
Codons 128/129 (–4 bp, –GCTG; +5 bp, +CCACA)
Codons 132-135 (–11 bp, –AAAGTGGTGGC) (SEQ ID NO: 5351)
Codons 134/135/136/137 [–(G)TGGCTGGTGT(G) (SEQ ID NO: 5352)
and +(G)GCAG(G)]; GTG•GCT•GGT•GTG (SEQ ID NO: 5353) (Val-
Ala-Gly-Val) (SEQ ID NO: 5354) ->GGC•AGG(Gly-Arg)
+1480 (C–>G); also known as 3' terminating codon +6 (C–>G)
3'UTR (–GCATCTGGATTCT) (SEQ ID NO: 5355) 13 bp deletion
between positions +1565 to +1577 (the numbers are relative to the
Cap site)

Those skilled in the art will also appreciate that a variety of deletional beta thalassemia alleles exist, which tend to be prevalent in certain at-risk populations. Examples of such deletional beta thalassemia alleles include, but are not limited to, a 25 bp deletion, a 44 bp deletion, a 105 bp deletion, a 290 bp deletion, a 532 bp deletion, a 619 bp deletion, a 1,393 bp deletion, a 1,605 bp deletion ("Croatian deletion"), a 3,485 bp deletion ("Thai deletion"), a 4,237 bp deletion ("Czech deletion"), a 7.6 kb deletion ("Turkish deletion"); a 10,329 bp deletion ("Asian Indian deletion"), a 12,023 bp deletion ("Australian deletion"); a 12,620 bp deletion ("Dutch deletion"), a 27 kb deletion ("Southeast Asian deletion"), a 45 kb deletion ("Filipino deletion"), and a 65 kb deletion ("Italian deletion"). Those skilled in the art will be able to retrieve the corresponding nucleic acid and protein sequences corresponding to these deletions from publicly available sources (e.g., A Syllabus of Thalassemia Mutations (1997) by Titus H. J. Huisman, et al, published by The Sickle Cell Anemia Foundation in Augusta, Ga., USA, available online at http://globin.cse.psu.edu/html/huisman/thals/l-b.entries.html).

An exemplary method for altering a target beta thalassemia-associated polynucleotide sequence in a cell comprises contacting the beta thalassemia-associated polynucleotide sequence with a clustered regularly interspaced short palindromic repeats-associated (Cas) protein and from one to two ribonucleic acids, wherein the ribonucleic acids direct Cas protein to and hybridize to a target motif of the target beta thalassemia-associated polynucleotide sequence, wherein the target beta thalassemia associated polynucleotide sequence is cleaved. In some embodiments of this and other aspects, the efficiency of alteration of cells that express Cas protein is from about 50% to about 80%.

As used herein, the term "contacting" (i.e., contacting a polynucleotide sequence with a clustered regularly interspaced short palindromic repeats-associated (Cas) protein and/or ribonucleic acids) is intended to include incubating the Cas protein and/or the ribonucleic acids in the cell together in vitro (e.g., adding the Cas protein or nucleic acid encoding the Cas protein to cells in culture). In some embodiments, the term "contacting" is not intended to include the in vivo exposure of cells to the Cas protein and/or ribonucleic acids as disclosed herein that may occur naturally in a microorganism (i.e., bacteria). The step of contacting a target polynucleotide sequence with a Cas protein and/or ribonucleic acids as disclosed herein can be conducted in any suitable manner. For example, the cells may be treated in adherent culture, or in suspension culture. It is understood that the cells contacted with a Cas protein and/or ribonucleic acids as disclosed herein can also be simultaneously or subsequently contacted with another agent, such as a growth factor or other differentiation agent or environments to stabilize the cells, or to differentiate the cells further.

In another aspect, the present invention provides a method for treating or preventing a disorder associated with expression of a polynucleotide sequence in a subject.

The terms "treat", "treating", "treatment", etc., as applied to an isolated cell, include subjecting the cell to any kind of process or condition or performing any kind of manipulation or procedure on the cell. As applied to a subject, the terms refer to providing medical or surgical attention, care, or management to an individual. The individual is usually ill or injured, or at increased risk of becoming ill relative to an average member of the population and in need of such attention, care, or management.

As used herein, the term "treating" and "treatment" refers to administering to a subject an effective amount of a composition so that the subject has a reduction in at least one symptom of the disease or an improvement in the disease, for example, beneficial or desired clinical results. For purposes of this invention, beneficial or desired clinical results include, but are not limited to, alleviation of one or more symptoms, diminishment of extent of disease, stabilized (i.e., not worsening) state of disease, delay or slowing of disease progression, amelioration or palliation of the disease state, and remission (whether partial or total), whether detectable or undetectable. Treating can refer to prolonging survival as compared to expected survival if not receiving treatment. Thus, one of skill in the art realizes that a treatment may improve the disease condition, but may not be a complete cure for the disease. As used herein, the term "treatment" includes prophylaxis. Alternatively, treatment is "effective" if the progression of a disease is reduced or halted. "Treatment" can also mean prolonging survival as compared to expected survival if not receiving treatment. Those in need of treatment include those already diagnosed with a disorder associated with expression of a polynucleotide sequence, as well as those likely to develop such a disorder due to genetic susceptibility or other factors.

By "treatment", "prevention" or "amelioration" of a disease or disorder is meant delaying or preventing the onset of such a disease or disorder, reversing, alleviating, ameliorating, inhibiting, slowing down or stopping the progression, aggravation or deterioration the progression or severity of a condition associated with such a disease or disorder. In one embodiment, the symptoms of a disease or disorder are alleviated by at least 5%, at least 10%, at least 20%, at least 30%, at least 40%, or at least 50%.

In some embodiments, a method for treating or preventing a disorder associated with expression of a polynucleotide sequence comprises a method for treating or preventing a disorder associated with expression of a SCID-associated polynucleotide sequence:

An exemplary method for treating or preventing a disorder associated with expression of a SCID-associated polynucleotide sequence in a subject comprises (a) altering a target SCID-associated polynucleotide sequence in a cell ex vivo by contacting the SCID-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCID-associated polynucleotide sequence, wherein the target SCD-associated polynucleotide sequence is cleaved, and (b) introducing the cell into the subject, thereby treating or preventing a disorder associated with expression of the SCID-associated polynucleotide sequence. In some embodiments of this and other aspects, the efficiency of alteration of cells that express Cas protein is from about 50% to about 80%.

An exemplary method for treating or preventing a disorder associated with expression of a SCID-associated polynucleotide sequence in a subject comprises altering a target SCID-associated polynucleotide sequence in a cell by contacting the SCID-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCID-associated polynucleotide sequence, and wherein the target SCID-associated polynucleotide sequence is cleaved, thereby treating or preventing a disorder associated with expression of the SCID-associated polynucleotide sequence.

In some embodiments, a method for treating or preventing a disorder associated with expression of a polynucleotide sequence comprises a method for treating or preventing a disorder associated with expression of a SCD-associated polynucleotide sequence.

An exemplary method for treating or preventing a disorder associated with expression of a SCD-associated polynucleotide sequence in a subject comprises (a) altering a target SCD-associated polynucleotide sequence in a cell ex vivo by contacting the SCD-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCD-associated polynucleotide sequence, wherein the target SCD-associated polynucleotide sequence is cleaved, and (b) introducing the cell into the subject, thereby treating or preventing a disorder associated with expression of the SCD-associated polynucleotide sequence. In some embodiments of this and other aspects, the efficiency of alteration of cells that express Cas protein is from about 50% to about 80%.

An exemplary method for treating or preventing a disorder associated with expression of a SCD-associated polynucleotide sequence in a subject comprises altering a target SCD-associated polynucleotide sequence in a cell by contacting the SCD-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCD-associated polynucleotide sequence, and wherein the target SCD-associated polynucleotide sequence is cleaved, thereby treating or preventing a disorder associated with expression of the SOD-associated polynucleotide sequence.

In some embodiments, a method for treating or preventing a disorder associated with expression of a polynucleotide sequence comprises a method for treating or preventing a disorder associated with expression of a beta thalassemia-associated polynucleotide sequence.

An exemplary method for treating or preventing a disorder associated with expression of a beta thalassemia-associated polynucleotide sequence in a subject comprises (a) altering a target beta thalassemia-associated polynucleotide sequence in a cell ex vivo by contacting the beta thalassemia-associated polynucleotide sequence with a clustered regularly interspaced short palindromic repeats-associated (Cas) protein and from one to two ribonucleic acids, wherein the ribonucleic acids direct Cas protein to and hybridize to a target motif of the target beta thalassemia-associated polynucleotide sequence, wherein the target beta thalassemia-associated polynucleotide sequence is cleaved, and (b) introducing the cell into the subject, thereby treating or preventing a disorder associated with expression of the beta thalassemia-associated polynucleotide sequence. In some embodiments of this and other aspects, the efficiency of alteration of cells that express Cas protein is from about 50% to about 80%.

An exemplary method for treating or preventing a disorder associated with expression of a beta thalassemia-associated polynucleotide sequence in a subject comprises altering a target beta thalassemia-associated polynucleotide sequence in a cell by contacting the beta thalassemia-associated polynucleotide sequence with a clustered regularly interspaced short palindromic repeats-associated (Cas) protein and from one to two ribonucleic acids, wherein the ribonucleic acids direct Cas protein to and hybridize to a target motif of the target beta thalassemia-associated polynucleotide sequence, and wherein the target beta thalassemia-associated polynucleotide sequence is cleaved, thereby treating or preventing a disorder associated with expression of the beta thalassemia-associated polynucleotide sequence.

The present invention contemplates altering target polynucleotide sequences in any manner which is available to the skilled artisan utilizing a CRISPR/Cas system of the present invention. Any CRISPR/Cas system that is capable of altering a target polynucleotide sequence in a cell can be used. Such CRISPR-Cas systems can employ a variety of Cas proteins (Haft et al. *PLoS Comput Biol.* 2005; 1(6)e60). The molecular machinery of such Cas proteins that allows the CRISPR/Cas system to alter target polynucleotide sequences in cells include RNA binding proteins, endo- and exo-nucleases, helicases, and polymerases. In some embodiments, the CRISPR/Cas system is a CRISPR type I system. In some embodiments, the CRISPR/Cas system is a CRISPR type II system.

The CRISPR/Cas systems of the present invention can be used to alter a target polynucleotide sequence in a cell. The present invention contemplates altering target polynucleotide sequences in a cell for any purpose. In some embodiments, the target polynucleotide sequence in a cell is altered to produce a mutant cell. As used herein, a "mutant cell" refers to a cell with a resulting genotype that differs from its original genotype. In some instances, a "mutant cell" exhibits a mutant phenotype, for example when a normally functioning gene is altered using the CRISPR/Cas systems of the present invention. In other instances, a "mutant cell" exhibits a wild-type phenotype, for example when a CRISPR/Cas system of the present invention is used to correct a mutant genotype. In exemplary embodiments, a mutant cell exhibits a wild-type ADA phenotype. In exemplary embodiments, a mutant cell exhibits a wild-type AK2 phenotype. In exemplary embodiments, a mutant cell exhibits a wild-type CD3D phenotype. In exemplary embodiments, a mutant cell exhibits a wild-type DCLRE1C phenotype. In exemplary embodiments, a mutant cell exhibits a wild-type IL2RG phenotype. In exemplary embodiments, a mutant cell exhibits a wild-type IL7R phenotype. In exemplary embodiments, a mutant cell exhibits a wild-type JAK3 phenotype. In exemplary embodiments, a mutant cell exhibits a wild-type LIG4 phenotype. In exemplary embodiments, a mutant cell exhibits a wild-type NHEJ1 phenotype. In exemplary embodiments, a mutant cell exhibits a wild-type PNP phenotype. In exemplary embodiments, a mutant cell exhibits a wild-type PRKDC phenotype. In exemplary embodiments, a mutant cell exhibits a wild-type RAG1 phenotype. In exemplary embodiments, a mutant cell exhibits a wild-type RAG2 phenotype. In exemplary embodiments, a mutant cell exhibits a wild-type ZAP70 phenotype. In exemplary embodiments, a mutant cell exhibits a wild-type HBB phenotype. In some embodiments, the target polynucleotide sequence in a cell is altered to correct or repair a genetic mutation (e.g., to restore a normal phenotype to the cell). In an exemplary embodiment, a target SCID-associated polynucleotide sequence in a cell is altered to correct or repair one or more ADA mutations involved in SCID. In an exemplary embodiment, a target SCID-associated polynucleotide sequence in a cell is altered to correct or repair one or more AK2 mutations involved in SCID. In an exemplary embodiment, a target SCID-associated polynucleotide sequence in a cell is altered to correct or repair one or more CD3D mutations involved in SCID. In an exemplary embodiment, a target SCID-associated polynucleotide sequence in a cell is altered to correct or repair one or more DCRE1C mutations involved in SCID. In an exemplary embodiment, a target SCID-associated polynucleotide sequence in a cell is altered to correct or repair one or more IL2RG mutations involved in SCID. In an exemplary embodiment, a target SCID-associated polynucleotide sequence in a cell is altered to correct or repair one or more IL7R mutations involved in SCID. In an exemplary embodiment, a target SCID-associated polynucleotide sequence in a cell is altered to correct or repair one or more JAK3 mutations involved in SCID. In an exemplary embodiment, a target SCID-associated polynucleotide sequence in a cell is altered to correct or repair one or more LIG4 mutations involved in SCID. In an exemplary embodiment, a target SCID-associated polynucleotide sequence in a cell is altered to correct or repair one or more NHEJ1 mutations involved in SCID. In an exemplary embodiment, a target SCID-associated polynucleotide sequence in a cell is altered to correct or repair one or more RAG2 mutations involved in SCID. In an exemplary embodiment, a target SCID-associated polynucleotide sequence in a cell is altered to correct or repair one or more PRKDC mutations involved in SCID. In an exemplary embodiment, a target SCID-associated polynucleotide sequence in a cell is altered to correct or repair one or more RAG1 mutations involved in SCID. In an exemplary embodiment, a target SCID-associated polynucleotide sequence in a cell is altered to correct or repair one or more RAG2 mutations involved in SCID. In an exemplary embodiment, a target SCID-associated polynucleotide sequence in a cell is altered to correct or repair one or more ZAP70 mutations involved in SCID. In an exemplary embodiment, a target SCD-associated polynucleotide sequence in a cell is altered to correct or repair one or more HBB mutations involved in SCD. In an exemplary embodiment, a target SCD-associated polynucleotide sequence in a cell is altered to correct or repair one or more HBB mutations involved in SCD. In another exemplary embodiment, a target beta thalassemia-associated polynucleotide sequence in a cell is altered to correct or repair one or more HBB mutations involved in beta thalassemia. In some embodiments, the target polynucleotide sequence in a cell is altered to induce a genetic mutation (e.g., to disrupt the function of a gene or genomic element).

In some embodiments, the alteration is an indel. As used herein, "indel" refers to a mutation resulting from an insertion, deletion, or a combination thereof. As will be appreciated by those skilled in the art, an indel in a coding region of a genomic sequence will result in a frameshift mutation, unless the length of the indel is a multiple of three. In some embodiments, the alteration is a point mutation. As used herein, "point mutation" refers to a substitution that replaces one of the nucleotides. A CRISPR/Cas system of the present invention can be used to induce an indel of any length or a point mutation in a target polynucleotide sequence.

In some embodiments, the alteration results in a knock out of the target polynucleotide sequence or a portion thereof. Knocking out a target polynucleotide sequence or a portion thereof using a CRISPR/Cas system of the present invention can be useful for a variety of applications. For example, knocking out a target polynucleotide sequence in a cell can be performed in vitro for research purposes. For ex vivo or in vivo purposes, knocking out a target polynucleotide sequence in a cell can be useful for treating or preventing a disorder associated with expression of the target polynucleotide sequence.

As used herein, "knock out" includes deleting all or a portion of the target polynucleotide sequence in a way that interferes with the function of the target polynucleotide sequence. For example, a knock out can be achieved by altering a target polynucleotide sequence by inducing an indel in the target polynucleotide sequence in a functional domain of the target polynucleotide sequence (e.g., a DNA binding domain). Those skilled in the art will readily appreciate how to use the CRISPR/Cas systems of the present invention to knock out a target polynucleotide sequence or a portion thereof based upon the details described herein.

In some embodiments, the alteration results in reduced expression of the target polynucleotide sequence. The terms "decrease," "reduced," "reduction," and "decrease" are all used herein generally to mean a decrease by a statistically significant amount. However, for avoidance of doubt, decrease," "reduced," "reduction," "decrease" means a decrease by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (i.e. absent level as compared to a reference sample), or any decrease between 10-100% as compared to a reference level.

In some embodiments, the alteration results in increased expression of the target polynucleotide sequence. The terms "increased", "increase" or "enhance" or "activate" are all used herein to generally mean an increase by a statically significant amount; for the avoidance of any doubt, the terms "increased", "increase" or "enhance" or "activate" means an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level.

The term "statistically significant" or "significantly" refers to statistical significance and generally means a two standard deviation (2SD) below normal, or lower, concentration of the marker. The term refers to statistical evidence that there is a difference. It is defined as the probability of making a decision to reject the null hypothesis when the null hypothesis is actually true. The decision is often made using the p-value.

In some embodiments, the alteration is a homozygous alteration. In some embodiments, the alteration is a heterozygous alteration.

In some embodiments, the alteration results in correction of the target polynucleotide sequence from an undesired sequence to a desired sequence. The CRISPR/Cas systems of the present invention can be used to correct any type of mutation or error in a target polynucleotide sequence. For example, the CRISPR/Cas systems of the present invention can be used to insert a nucleotide sequence that is missing from a target polynucleotide sequence due to a deletion. The CRISPR/Cas systems of the present invention can also be used to delete or excise a nucleotide sequence from a target polynucleotide sequence due to an insertion mutation. In some instances, the CRISPR/Cas systems of the present invention can be used to replace an incorrect nucleotide sequence with a correct nucleotide sequence (e.g., to restore function to a target polynucleotide sequence that is impaired due to a loss of function mutation, i.e., a SNP).

In exemplary embodiments, the CRISPR/Cas systems of the present invention can be used to replace mutant ADA polynucleotide sequences with wild-type ADA polynucleotide sequences.

In exemplary embodiments, the CRISPR/Cas systems of the present invention can be used to replace mutant AK2 polynucleotide sequences with wild-type AK2 polynucleotide sequences.

In exemplary embodiments, the CRISPR/Cas systems of the present invention can be used to replace mutant CD3D polynucleotide sequences with wild-type CD3D polynucleotide sequences.

In exemplary embodiments, the CRISPR/Cas systems of the present invention can be used to replace mutant DCLRE1C polynucleotide sequences with wild-type DCLRE1C polynucleotide sequences.

In exemplary embodiments, the CRISPR/Cas systems of the present invention can be used to replace mutant IL2RG polynucleotide sequences with wild-type IL2RG polynucleotide sequences.

In exemplary embodiments, the CRISPR/Cas systems of the present invention can be used to replace mutant IL7R polynucleotide sequences with wild-type IL7R polynucleotide sequences.

In exemplary embodiments, the CRISPR/Cas systems of the present invention can be used to replace mutant JAK3 polynucleotide sequences with wild-type JAK3 polynucleotide sequences.

In exemplary embodiments, the CRISPR/Cas systems of the present invention can be used to replace mutant LIG4 polynucleotide sequences with wild-type LIG4 polynucleotide sequences.

In exemplary embodiments, the CRISPR/Cas systems of the present invention can be used to replace mutant NHEJ1 polynucleotide sequences with wild-type NHEJ1 polynucleotide sequences.

In exemplary embodiments, the CRISPR/Cas systems of the present invention can be used to replace mutant PNP polynucleotide sequences with wild-type PNP polynucleotide sequences.

In exemplary embodiments, the CRISPR/Cas systems of the present invention can be used to replace mutant PRKDC polynucleotide sequences with wild-type PRKDC polynucleotide sequences.

In exemplary embodiments, the CRISPR/Cas systems of the present invention can be used to replace mutant RAG1 polynucleotide sequences with wild-type RAG1 polynucleotide sequences.

In exemplary embodiments, the CRISPR/Cas systems of the present invention can be used to replace mutant RAG2 polynucleotide sequences with wild-type RAG2 polynucleotide sequences.

In exemplary embodiments, the CRISPR/Cas systems of the present invention can be used to replace mutant ZAP70 polynucleotide sequences with wild-type ZAP70 polynucleotide sequences.

In exemplary embodiments, the CRISPR/Cas systems of the present invention can be used to replace mutant HBB polynucleotide sequences with wild-type HBB polynucleotide sequences.

The CRISPR/Cas systems of the present invention can alter target polynucleotides with surprisingly high efficiency as compared to conventional CRISPR/Cas systems. In certain embodiments, the efficiency of alteration is at least about 5%. In certain embodiments, the efficiency of alteration is at least about 10%. In certain embodiments, the efficiency of alteration is from about 10% to about 80%. In certain embodiments, the efficiency of alteration is from about 30% to about 80%. In certain embodiments, the efficiency of alteration is from about 50% to about 80%. In some embodiments, the efficiency of alteration is greater than or equal to about 80%.

The CRISPR/Cas systems of the present invention can be used to alter any target polynucleotide sequence in a cell. Those skilled in the art will readily appreciate that desirable target polynucleotide sequences to be altered in any particular cell may correspond to any genomic sequence for which expression of the genomic sequence is associated with a disorder or otherwise facilitates entry of a pathogen into the cell. For example, a desirable target polynucleotide sequence to alter in a cell may be a polynucleotide sequence corresponding to a genomic sequence which contains a disease associated single polynucleotide polymorphism (e.g., sickle cell disease, e.g., sickle cell anemia). In such example, the CRISPR/Cas systems of the present invention can be used to correct the disease associated SNP by replacing it with a wild-type allele (e.g., replacing a Glu6Val SNP in hemoglobin S to Val6Glu, a Glu6Lys SNP in hemoglobin C to Lys6Glu, a Glu121Gln SNP in hemoglobin D to Gln121Glu, a Glu121Lys SNP in hemoglobin O to Lys121Glu). As another example, a polynucleotide sequence of a target gene which is responsible for entry or proliferation of a pathogen into a cell may be a suitable target for deletion or insertion to disrupt the function of the target gene to prevent the pathogen from entering the cell or proliferating inside the cell.

In some embodiments, the target polynucleotide sequence is a genomic sequence. In some embodiments, the target polynucleotide sequence is a human genomic sequence. In some embodiments, the target polynucleotide sequence is a mammalian genomic sequence. In some embodiments, the target polynucleotide sequence is a vertebrate genomic sequence. In some embodiments, the target sequence is a mutant or variant genomic sequence (e.g., a ADA mutant, a AK2 mutant, a CD3D mutant, a DCLREIC mutant, a IL2RG mutant, a IL7R mutant, a JAK3 mutant, a LIG4 mutant, a NHEJ1 mutant, a PNP mutant, a PRKDC mutant, a RAG1 mutant, a RAG2 mutant, a ZAP70 mutant, a HBB mutant). In some embodiments, the target polynucleotide sequence is a human genomic mutant or variant sequence (e.g., ADA, AK2, CD3D, DCLREIC, IL2RG, IL7R, JAK3, LIG4, NHEJ1, PNP, PRKDC, RAG1, RAG2, ZAP70, HBB). In some embodiments, the target polynucleotide sequence is a mutant or variant mammalian genomic sequence. In some embodiments, the target polynucleotide sequence is a mammalian mutant or variant genomic sequence.

In some embodiments, a target polynucleotide sequence is a pathogenic genomic sequence. Exemplary pathogenic genomic sequences include, but are not limited to a viral genomic sequence, a bacterial genomic sequence, a fungal genomic sequence, a toxin genomic sequence, or a parasitic genomic sequence. In such embodiments, the CRISPR/Cas systems of the present invention can be used to disrupt the function of a pathogen (e.g., to treat or prevent an infection by the pathogen) by cleaving a genomic sequence of the pathogen (e.g., a genomic sequence that is critical for entry into a cell, or responsible for multiplication, growth or survival once the pathogen is inside a cell).

In some embodiments, the target polynucleotide sequence is an SCID-associated polynucleotide sequence.

In some embodiments, the target polynucleotide sequence is ADA or a portion thereof. In some embodiments, the target polynucleotide sequence is a variant of ADA or a portion thereof. In some embodiments, the target polynucleotide sequence is a homolog of ADA or a portion thereof. In some embodiments, the target polynucleotide sequence is an ortholog of ADA or a portion thereof.

In some embodiments, the target polynucleotide sequence is AK2 or a portion thereof. In some embodiments, the target polynucleotide sequence is a variant of AK2 or a portion thereof. In some embodiments, the target polynucleotide sequence is AK2 coding sequence 1 or a portion thereof. In some embodiments, the target polynucleotide sequence is AK2 coding sequence 2 or a portion thereof. In some embodiments, the target polynucleotide sequence is AK2 coding sequence 3 or a portion thereof. In some embodiments, the target polynucleotide sequence is a homolog of AK2 or a portion thereof. In some embodiments, the target polynucleotide sequence is an ortholog of AK2 or a portion thereof.

In some embodiments, the target polynucleotide sequence is CD3D or a portion thereof. In some embodiments, the target polynucleotide sequence is a variant of CD3D or a portion thereof. In some embodiments, the target polynucleotide sequence is CD3D coding sequence 1 or a portion thereof. In some embodiments, the target polynucleotide sequence is CD3D coding sequence 2 or a portion thereof. In some embodiments, the target polynucleotide sequence is a homolog of CD3D or a portion thereof. In some embodiments, the target polynucleotide sequence is an ortholog of CD3D or a portion thereof.

In some embodiments, the target polynucleotide sequence is DCLREIC or a portion thereof. In some embodiments, the target polynucleotide sequence is a variant of DCLRE1C or a portion thereof. In some embodiments, the target polynucleotide sequence is DCLREIC coding sequence 1 or a portion thereof. In some embodiments, the target polynucleotide sequence is DCLREIC coding sequence 1 or a portion thereof. In some embodiments, the target polynucleotide sequence is DCLREIC coding sequence 2 or a portion thereof. In some embodiments, the target polynucleotide sequence is DCLREIC coding sequence 3 or a portion thereof. In some embodiments, the target polynucleotide sequence is DCLREIC coding sequence 4 or a portion thereof. In some embodiments, the target polynucleotide sequence is a homolog of DCLREIC or a portion thereof. In some embodiments, the target polynucleotide sequence is an ortholog of DCLREIC or a portion thereof.

In some embodiments, the target polynucleotide sequence is IL2RG or a portion thereof. In some embodiments, the target polynucleotide sequence is a variant of IL2RG or a portion thereof. In some embodiments, the target polynucleotide sequence is a homolog of IL2RG or a portion thereof. In some embodiments, the target polynucleotide sequence is an ortholog of IL2RG or a portion thereof.

In some embodiments, the target polynucleotide sequence is IL7R or a portion thereof. In some embodiments, the target polynucleotide sequence is a variant of IL7R or a portion thereof. In some embodiments, the target polynucleotide sequence is a homolog of IL7R or a portion thereof. In some embodiments, the target polynucleotide sequence is an ortholog of IL7R or a portion thereof.

In some embodiments, the target polynucleotide sequence is JAK3 or a portion thereof. In some embodiments, the target polynucleotide sequence is a variant of JAK3 or a portion thereof. In some embodiments, the target polynucleotide sequence is a homolog of JAK3 or a portion thereof. In some embodiments, the target polynucleotide sequence is an ortholog of JAK3 or a portion thereof.

In some embodiments, the target polynucleotide sequence is LIG4 or a portion thereof. In some embodiments, the target polynucleotide sequence is a variant of LIG4 or a portion thereof. In some embodiments, the target polynucleotide sequence is LIG4 coding sequence 1 or a portion thereof. In some embodiments, the target polynucleotide sequence is LIG4 coding sequence 2 or a portion thereof. In some embodiments, the target polynucleotide sequence is LIG4 coding sequence 3 or a portion thereof. In some embodiments, the target polynucleotide sequence is a homolog of LIG4 or a portion thereof. In some embodiments, the target polynucleotide sequence is an ortholog of LIG4 or a portion thereof.

In some embodiments, the target polynucleotide sequence is NHEJ1 or a portion thereof. In some embodiments, the target polynucleotide sequence is a variant of PNP or a portion thereof. In some embodiments, the target polynucleotide sequence is a homolog of NHEJ1 or a portion thereof. In some embodiments, the target polynucleotide sequence is an ortholog of NHEJ1 or a portion thereof.

In some embodiments, the target polynucleotide sequence is PNP or a portion thereof. In some embodiments, the target polynucleotide sequence is a variant of PNP or a portion thereof. In some embodiments, the target polynucleotide sequence is a homolog of PNP or a portion thereof. In some embodiments, the target polynucleotide sequence is an ortholog of PNP or a portion thereof.

In some embodiments, the target polynucleotide sequence is PRKDC or a portion thereof. In some embodiments, the target polynucleotide sequence is a variant of PRKDC or a portion thereof. In some embodiments, the target polynucleotide sequence is PRKDC coding sequence 1 or a portion thereof. In some embodiments, the target polynucleotide sequence is PRKDC coding sequence 2 or a portion thereof. In some embodiments, the target polynucleotide sequence is a homolog of PRKDC or a portion thereof. In some embodiments, the target polynucleotide sequence is an ortholog of PRKDC or a portion thereof.

In some embodiments, the target polynucleotide sequence is RAG1 or a portion thereof. In some embodiments, the target polynucleotide sequence is a variant of RAG1 or a portion thereof. In some embodiments, the target polynucleotide sequence is a homolog of RAG1 or a portion thereof. In some embodiments, the target polynucleotide sequence is an ortholog of RAG1 or a portion thereof.

In some embodiments, the target polynucleotide sequence is RAG2 or a portion thereof. In some embodiments, the target polynucleotide sequence is a variant of RAG2 or a portion thereof. In some embodiments, the target polynucleotide sequence is RAG2 coding sequence 1 or a portion thereof. In some embodiments, the target polynucleotide sequence is RAG2 coding sequence 2 or a portion thereof. In some embodiments, the target polynucleotide sequence is RAG2 coding sequence 3 or a portion thereof. In some embodiments, the target polynucleotide sequence is a homolog of RAG2 or a portion thereof. In some embodiments, the target polynucleotide sequence is an ortholog of RAG2 or a portion thereof.

In some embodiments, the target polynucleotide sequence is ZAP70 or a portion thereof. In some embodiments, the target polynucleotide sequence is a variant of ZAP70 or a portion thereof. In some embodiments, the target polynucleotide sequence is ZAP70 coding sequence 1 or a portion thereof. In some embodiments, the target polynucleotide sequence is ZAP70 coding sequence 2 or a portion thereof. In some embodiments, the target polynucleotide sequence is a homolog of ZAP70 or a portion thereof. In some embodiments, the target polynucleotide sequence is an ortholog of ZAP70 or a portion thereof.

In some embodiments, the target polynucleotide sequence is a SCD-associated polynucleotide sequence (e.g., a mutant form of HBB; NCBI Gene ID: 3043) or a portion thereof. In some embodiments, the target polynucleotide sequence is a mutant homolog of a SCD-associated polynucleotide sequence (e.g., a mutated homolog of HBB) or a portion thereof. In some embodiments, the target polynucleotide sequence is a mutant ortholog of a SCD-associated polynucleotide sequence (e.g., a mutated ortholog of HBB) or a portion thereof.

In some embodiments, the target polynucleotide sequence is a beta thalassemia-associated polynucleotide sequence (e.g., a mutant form of HBB).

In some embodiments, the target polynucleotide sequence is a mutant homolog of a beta thalassemia-associated polynucleotide sequence (e.g., a mutated homolog of HBB) or a portion thereof. In some embodiments, the target polynucleotide sequence is a mutant ortholog of a beta thalassemia-associated polynucleotide sequence (e.g., a mutated ortholog of HBB) or a portion thereof. The relevant portions of these target polynucleotide sequences correspond to the guide sequences shown in FIGS. 1, 2-4, 5-6, 7-10, 12, 13, 14, 15-17, 18, 19, 20-21, 22, 23-25, 26-27, and 11, respectively.

It should be appreciated that the CRISPR/Cas systems of the present invention can cleave target polynucleotide sequences in a variety of ways. In some embodiments, the target polynucleotide sequence is cleaved such that a double-strand break results. In some embodiments, the target polynucleotide sequence is cleaved such that a single-strand break results.

The methods of the present invention can be used to alter any target polynucleotide sequence in a cell, as long as the target polynucleotide sequence in the cell contains a suitable target motif that allows at least one ribonucleic acid of the CRISPR/Cas system to direct the Cas protein to and hybridize to the target motif. Those skilled in the art will appreciate that the target motif for targeting a particular polynucleotide depends on the CRISPR/Cas system being used, and the sequence of the polynucleotide to be targeted.

In some embodiments, the target motif is at least 20 bp in length. In some embodiments, the target motif is a 20-nucleotide DNA sequence. In some embodiments, the target motif is a 20-nucleotide DNA sequence beginning with G and immediately precedes an NGG motif recognized by the Cas protein. In some embodiments, the target motif is $G(N)_{19}NGG$. In some embodiments, the target motif is a 20-nucleotide DNA sequence and immediately precedes an NGG motif recognized by the Cas protein. In some embodiments, the target motif is $(N)_{20}NGG$. It is to be understood that the type of target motif for each of the ADA, AK2, CD3D, DCLREIC, HBB, IL2RG, IL7R, JAK3, LIG4, NHEJ1, PNP, PRKDC, RAG1, RAG2, and ZAP70 target polynucleotide sequences can be found in the "site_type" column of FIGS. 1, 2-4, 5-6, 7-10, 11, 12, 13, 14, 15-17, 18, 19, 20-21, 22, 23-25, and 26-27, respectively.

The target motifs of the present invention can be selected to minimize off-target effects of the CRISPR/Cas systems of the present invention. In some embodiments, the target motif is selected such that it contains at least two mismatches when compared with all other genomic nucleotide sequences in the cell. In some embodiments, the target motif is selected such that it contains at least one mismatch when compared with all other genomic nucleotide sequences in the cell. Those skilled in the art will appreciate that a variety of techniques can be used to select suitable target motifs for minimizing off-target effects (e.g., bioinformatics analyses).

In some embodiments, the CRISPR/Cas systems of the present invention utilize homology-directed repair to correct target polynucleotide sequences. In some embodiments, subsequent to cleavage of the target polynucleotide sequence, homology-directed repair occurs. In some embodiments, homology-directed repair is performed using an exogenously introduced DNA repair template. The exogenously introduced DNA repair template can be single-stranded or double-stranded. The DNA repair template can be of any length. Those skilled in the art will appreciate that the length of any particular DNA repair template will depend on the target polynucleotide sequence that is to be corrected. The DNA repair template can be designed to repair or replace any target polynucleotide sequence, particularly target polynucleotide sequences comprising disease associated polymorphisms (e.g., SNPs). For example, homology-directed repair of a mutant allele comprising such SNPs can be achieved with a CRISPR/Cas system by selecting two target motifs which flank the mutant allele, and an designing a DNA repair template to match the wild-type allele.

In an exemplary embodiment, a cleaved target SCID-associated polynucleotide associated sequence is corrected by homology-directed repair utilizing a corresponding normal wild-type gene sequence as a DNA repair template.

In an exemplary embodiment, a cleaved target SCID-associated polynucleotide associated sequence (i.e., mutant ADA) is corrected by homology-directed repair utilizing a normal wild-type ADA sequence or portions thereof as a DNA repair template.

In an exemplary embodiment, a cleaved target SCID-associated polynucleotide associated sequence (i.e., mutant AK2) is corrected by homology-directed repair utilizing a normal wild-type AK2 sequence (e.g., wild-type AK2 coding sequence 1, AK2 coding sequence 2, and AK2 coding sequence 3 or portions thereof) as a DNA repair template.

In an exemplary embodiment, a cleaved target SCID-associated polynucleotide associated sequence (i.e., mutant CD3D) is corrected by homology-directed repair utilizing a normal wild-type CD3D sequence (e.g., wild-type CD3D coding sequence 1, and CD3D coding sequence 2 or portions thereof) as a DNA repair template.

In an exemplary embodiment, a cleaved target SCID-associated polynucleotide associated sequence (i.e., mutant DCLRE1C) is corrected by homology-directed repair utilizing a normal wild-type DCLRE1C sequence (e.g., wild-type DCLRE1C coding sequence 1, DCLRE1C coding sequence 2, DCLRE1C coding sequence 3, and DCLRE1C coding sequence 4 or portions thereof) as a DNA repair template.

In an exemplary embodiment, a cleaved target SCID-associated polynucleotide associated sequence (i.e., mutant IL2RG) is corrected by homology-directed repair utilizing a normal wild-type IL2RG sequence or portions thereof as a DNA repair template.

In an exemplary embodiment, a cleaved target SCID-associated polynucleotide associated sequence (i.e., mutant IL7R) is corrected by homology-directed repair utilizing a normal wild-type IL7R sequence or portions thereof as a DNA repair template.

In an exemplary embodiment, a cleaved target SCID-associated polynucleotide associated sequence (i.e., mutant JAK3) is corrected by homology-directed repair utilizing a normal wild-type JAK3 sequence or portions thereof as a DNA repair template.

In an exemplary embodiment, a cleaved target SCID-associated polynucleotide associated sequence (i.e., mutant LIG4) is corrected by homology-directed repair utilizing a normal wild-type LIG4 sequence (e.g., wild-type LIG4 coding sequence 1, LIG4 coding sequence 2, LIG4 coding sequence 3, or portions thereof) as a DNA repair template.

In an exemplary embodiment, a cleaved target SCID-associated polynucleotide associated sequence (i.e., mutant NHEJ1) is corrected by homology-directed repair utilizing a normal wild-type NHEJ1 sequence or portions thereof as a DNA repair template.

In an exemplary embodiment, a cleaved target SCID-associated polynucleotide associated sequence (i.e., mutant PNP) is corrected by homology-directed repair utilizing a normal wild-type PNP sequence or portions thereof as a DNA repair template.

In an exemplary embodiment, a cleaved target SCID-associated polynucleotide associated sequence (i.e., mutant PRKDC) is corrected by homology-directed repair utilizing a normal wild-type PRKDC sequence (e.g., wild-type PRKDC coding sequence 1, PRKDC coding sequence 2, or portions thereof) as a DNA repair template.

In an exemplary embodiment, a cleaved target SCID-associated polynucleotide associated sequence (i.e., mutant RAG1) is corrected by homology-directed repair utilizing a normal wild-type RAG1 sequence or portions thereof as a DNA repair template.

In an exemplary embodiment, a cleaved target SCID-associated polynucleotide associated sequence (i.e., mutant RAG2) is corrected by homology-directed repair utilizing a normal wild-type RAG2 sequence (e.g., wild-type RAG2 coding sequence 1, RAG2 coding sequence 2, RAG2 coding sequence 3, or portions thereof) as a DNA repair template.

In an exemplary embodiment, a cleaved target SCID-associated polynucleotide associated sequence (i.e., mutant ZAP70) is corrected by homology-directed repair utilizing a normal wild-type ZAP70 sequence (e.g., wild-type ZAP70 coding sequence 1, ZAP70 coding sequence 2, or portions thereof) as a DNA repair template.

In an exemplary embodiment, a cleaved target SCD-associated polynucleotide associated sequence is corrected by homology-directed repair utilizing a normal wild-type HBB sequence or portions thereof as a DNA repair template.

In an exemplary embodiment, a cleaved target beta thalassemia-associated polynucleotide associated sequence is corrected by homology-directed repair utilizing a normal wild-type HBB sequence or portions thereof as a DNA repair template.

In some embodiments, a CRISPR/Cas system of the present invention includes a Cas protein and at least one to two one ribonucleic acids that are capable of directing the Cas protein to and hybridizing to a target motif of a target polynucleotide sequence.

As used herein, "protein" and "polypeptide" are used interchangeably to refer to a series of amino acid residues joined by peptide bonds (i.e., a polymer of amino acids) and include modified amino acids (e.g., phosphorylated, glycated, glycosolated, etc.) and amino acid analogs. Exemplary polypeptides or proteins include gene products, naturally occurring proteins, homologs, paralogs, fragments and other equivalents, variants, and analogs of the above.

In some embodiments, a Cas protein comprises one or more amino acid substitutions or modifications. In some embodiments, the one or more amino acid substitutions comprises a conservative amino acid substitution. In some instances, substitutions and/or modifications can prevent or reduce proteolytic degradation and/or extend the half-life of the polypeptide in a cell. In some embodiments, the Cas protein can comprise a peptide bond replacement (e.g., urea, thiourea, carbamate, sulfonyl urea, etc.). In some embodiments, the Cas protein can comprise a naturally occurring amino acid. In some embodiments, the Cas protein can comprise an alternative amino acid (e.g., D-amino acids, beta-amino acids, homocysteine, phosphoserine, etc.). In some embodiments, a Cas protein can comprise a modification to include a moiety (e.g., PEGylation, glycosylation, lipidation, acetylation, end-capping, etc.).

In some embodiments, a Cas protein comprises a core Cas protein. Exemplary Cas core proteins include, but are not limited to Cas1, Cast, Cas3, Cas4, Cas5, Cas6, Cas7, Cas8 and Cas9. In some embodiments, a Cas protein comprises a Cas protein of an *E. coli* subtype (also known as CASS2). Exemplary Cas proteins of the *E. Coli* subtype include, but are not limited to Cse1, Cse2, Cse3, Cse4, and Cas5e. In some embodiments, a Cas protein comprises a Cas protein of the Ypest subtype (also known as CASS3). Exemplary Cas proteins of the Ypest subtype include, but are not limited to Csy1, Csy2, Csy3, and Csy4. In some embodiments, a Cas protein comprises a Cas protein of the Nmeni subtype (also known as CASS4). Exemplary Cas proteins of the Nmeni subtype include, but are not limited to Csn1 and Csn2. In some embodiments, a Cas protein comprises a Cas protein of the Dvulg subtype (also known as CASS1). Exemplary Cas proteins of the Dvulg subtype include Csd1, Csd2, and Cas5d. In some embodiments, a Cas protein comprises a Cas protein of the Tneap subtype (also known as CASS7). Exemplary Cas proteins of the Tneap subtype include, but are not limited to, Cst1, Cst2, Cas5h. In some embodiments, a Cas protein comprises a Cas protein of the Hmari subtype. Exemplary Cas proteins of the Hmari subtype include, but are not limited to Csh1, Csh2, and Cas5h. In some embodiments, a Cas protein comprises a Cas protein of the Apern subtype (also known as CASS5). Exemplary Cas proteins of the Apern subtype include, but are not limited to Csa1, Csa2, Csa3, Csa4, Csa5, and Cas5a. In some embodiments, a Cas protein comprises a Cas protein of the Mtube subtype (also known as CASS6). Exemplary Cas proteins of the Mtube subtype include, but are not limited to Csm1, Csm2, Csm3, Csm4, and Csm5. In some embodiments, a Cas protein comprises a RAMP module Cas protein. Exemplary RAMP module Cas proteins include, but are not limited to, Cmr1, Cmr2, Cmr3, Cmr4, Cmr5, and Cmr6.

In some embodiments, the Cas protein is a *Streptococcus pyogenes* Cas9 protein or a functional portion thereof. In some embodiments, the Cas protein is Cas9 protein from any bacterial species or functional portion thereof. Cas9 protein is a member of the type II CRISPR systems which typically include a trans-coded small RNA (tracrRNA), endogenous ribonuclease 3 (rnc) and a Cas protein. Cas 9 protein (also known as CRISPR-associated endonuclease Cas9/Csn1) is a polypeptide comprising 1368 amino acids. An exemplary amino acid sequence of a Cas9 protein (SEQ ID NO: 298) is shown in FIG. 28. Cas 9 contains 2 enconuclease domains, including an RuvC-like domain (residues 7-22, 759-766 and 982-989) which cleaves target DNA that is noncomplementary to crRNA, and an HNH nuclease domain (residues 810-872) which cleave target DNA complementary to crRNA. In FIG. 28, the RuvC-like domain is highlighted in yellow and the HNH nuclease domain is underlined.

As used herein, "functional portion" refers to a portion of a peptide which retains its ability to complex with at least one ribonucleic acid (e.g., guide RNA (gRNA)) and cleave a target polynucleotide sequence. In some embodiments, the functional portion comprises a combination of operably linked Cas9 protein functional domains selected from the group consisting of a DNA binding domain, at least one RNA binding domain, a helicase domain, and an endonuclease domain. In some embodiments, the functional domains form a complex.

In some embodiments, a functional portion of the Cas9 protein comprises a functional portion of a RuvC-like domain. In some embodiments, a functional portion of the Cas9 protein comprises a functional portion of the HNH nuclease domain.

It should be appreciated that the present invention contemplates various of ways of contacting a target polynucleotide sequence with a Cas protein (e.g., Cas9). In some embodiments, exogenous Cas protein can be introduced into the cell in polypeptide form. In certain embodiments, Cas proteins can be conjugated to or fused to a cell-penetrating polypeptide or cell-penetrating peptide. As used herein, "cell-penetrating polypeptide" and "cell-penetrating peptide" refers to a polypeptide or peptide, respectively, which facilitates the uptake of molecule into a cell. The cell-penetrating polypeptides can contain a detectable label.

In certain embodiments, Cas proteins can be conjugated to or fused to a charged protein (e.g., that carries a positive, negative or overall neutral electric charge). Such linkage may be covalent. In some embodiments, the Cas protein can be fused to a superpositively charged GFP to significantly increase the ability of the Cas protein to penetrate a cell (Cronican et al. *ACS Chem Biol.* 2010; 5(8):747-52).

In certain embodiments, the Cas protein can be fused to a protein transduction domain (PTD) to facilitate its entry into a cell. Exemplary PTDs include Tat, oligoarginine, and penetratin.

In some embodiments, the Cas9 protein comprises a Cas9 polypeptide fused to a cell-penetrating peptide. In some embodiments, the Cas9 protein comprises a Cas9 polypeptide fused to a PTD. In some embodiments, the Cas9 protein comprises a Cas9 polypeptide fused to a tat domain. In some embodiments, the Cas9 protein comprises a Cas9 polypeptide fused to an oligoarginine domain. In some embodiments, the Cas9 protein comprises a Cas9 polypeptide fused to a penetratin domain. In some embodiments, the Cas9 protein comprises a Cas9 polypeptide fused to a superpositively charged GFP.

In some embodiments, the Cas protein can be introduced into a cell containing the target polynucleotide sequence in the form of a nucleic acid encoding the Cas protein (e.g., Cas9). The process of introducing the nucleic acids into cells can be achieved by any suitable technique. Suitable techniques include calcium phosphate or lipid-mediated transfection, electroporation, and transduction or infection using a viral vector. In some embodiments, the nucleic acid comprises DNA. In some embodiments, the nucleic acid comprises a modified DNA, as described herein. In some embodiments, the nucleic acid comprises mRNA. In some embodiments, the nucleic acid comprises a modified mRNA, as described herein (e.g., a synthetic, modified mRNA).

In some embodiments, the Cas protein is complexed with the one to two ribonucleic acids. In some embodiments, the Cas protein and the one to two ribonucleic acids are contained in a nanoparticle. In some embodiments, the Cas protein and the one to two ribonucleic acids are contained in a lipid nanoparticle, as described herein. In some embodiments, the Cas protein is encoded by a modified nucleic acid, as described herein (e.g., a synthetic, modified mRNA).

The methods of the present invention contemplate the use of any ribonucleic acid that is capable of directing a Cas protein to and hybridizing to a target motif of a target polynucleotide sequence. In some embodiments, at least one of the ribonucleic acids comprises tracrRNA. In some embodiments, at least one of the ribonucleic acids comprises CRISPR RNA (crRNA). In some embodiments, at least one of the ribonucleic acids comprises a guide RNA that directs the Cas protein to and hybridizes to a target motif of the target polynucleotide sequence in a cell.

The ribonucleic acids of the present invention can be selected to hybridize to a variety of different target motifs, depending on the particular CRISPR/Cas system employed, and the sequence of the target polynucleotide, as will be appreciated by those skilled in the art. The one to two ribonucleic acids can also be selected to minimize hybridization with nucleic acid sequences other than the target polynucleotide sequence. In some embodiments, the one to two ribonucleic acids hybridize to a target motif that contains at least two mismatches when compared with all other genomic nucleotide sequences in the cell. In some embodiments, the one to two ribonucleic acids hybridize to a target motif that contains at least one mismatch when compared with all other genomic nucleotide sequences in the cell. In some embodiments, the one to two ribonucleic acids are designed to hybridize to a target motif immediately adjacent to a deoxyribonucleic acid motif recognized by the Cas protein. In some embodiments, each of the one to two ribonucleic acids are designed to hybridize to target motifs immediately adjacent to deoxyribonucleic acid motifs recognized by the Cas protein which flank a mutant allele located between the target motifs.

In some embodiments, at least one of the one to two ribonucleic acids comprises a sequence selected from the group consisting of the ribonucleic acid sequence of GTAACGGCAGACTTCTCCAC (SEQ ID NO: 5322). In some embodiments, at least one of the one to two ribonucleic acids comprises a sequence selected from the group consisting of the ribonucleic acid sequence of GTAACG-GCAGACTTCTCCACAGG (SEQ ID NO: 5321). It should be appreciated that the former sequence is the protospacer sequence in the guide RNA, whereas the latter sequence is the protospacer plus the PAM.

In some embodiments, at least one of the one to two ribonucleic acids comprises a sequence selected from the group consisting of the ribonucleic acid sequences of FIG. 1.

In some embodiments, at least one of the one to two ribonucleic acids comprises a sequence with a single nucleotide mismatch to a sequence selected from the group consisting of the ribonucleic acid sequences of FIG. 1.

In some embodiments, at least one of the one to two ribonucleic acids comprises a sequence selected from the group consisting of the ribonucleic acid sequences of FIG. 2. In some embodiments, at least one of the one to two ribonucleic acids comprises a sequence with a single nucleotide mismatch to a sequence selected from the group consisting of the ribonucleic acid sequences of FIG. 2.

In some embodiments, at least one of the one to two ribonucleic acids comprises a sequence selected from the group consisting of the ribonucleic acid sequences of FIG. 3. In some embodiments, at least one of the one to two ribonucleic acids comprises a sequence with a single nucleotide mismatch to a sequence selected from the group consisting of the ribonucleic acid sequences of FIG. 3.

In some embodiments, at least one of the one to two ribonucleic acids comprises a sequence selected from the group consisting of the ribonucleic acid sequences of FIG. 4. In some embodiments, at least one of the one to two ribonucleic acids comprises a sequence with a single nucleotide mismatch to a sequence selected from the group consisting of the ribonucleic acid sequences of FIG. 4.

In some embodiments, at least one of the one to two ribonucleic acids comprises a sequence selected from the group consisting of the ribonucleic acid sequences of FIG. 5. In some embodiments, at least one of the one to two ribonucleic acids comprises a sequence with a single nucleotide mismatch to a sequence selected from the group consisting of the ribonucleic acid sequences of FIG. 5.

In some embodiments, at least one of the one to two ribonucleic acids comprises a sequence selected from the group consisting of the ribonucleic acid sequences of FIG. 6. In some embodiments, at least one of the one to two ribonucleic acids comprises a sequence with a single nucleotide mismatch to a sequence selected from the group consisting of the ribonucleic acid sequences of FIG. 6.

In some embodiments, at least one of the one to two ribonucleic acids comprises a sequence selected from the group consisting of the ribonucleic acid sequences of FIG. 7. In some embodiments, at least one of the one to two ribonucleic acids comprises a sequence with a single nucleotide mismatch to a sequence selected from the group consisting of the ribonucleic acid sequences of FIG. 7.

In some embodiments, at least one of the one to two ribonucleic acids comprises a sequence selected from the group consisting of the ribonucleic acid sequences of FIG. 8. In some embodiments, at least one of the one to two ribonucleic acids comprises a sequence with a single nucleotide mismatch to a sequence selected from the group consisting of the ribonucleic acid sequences of FIG. 8.

In some embodiments, at least one of the one to two ribonucleic acids comprises a sequence selected from the group consisting of the ribonucleic acid sequences of FIG. 9. In some embodiments, at least one of the one to two ribonucleic acids comprises a sequence with a single nucleotide mismatch to a sequence selected from the group consisting of the ribonucleic acid sequences of FIG. 9.

In some embodiments, at least one of the one to two ribonucleic acids comprises a sequence selected from the group consisting of the ribonucleic acid sequences of FIG. 10. In some embodiments, at least one of the one to two ribonucleic acids comprises a sequence with a single nucleotide mismatch to a sequence selected from the group consisting of the ribonucleic acid sequences of FIG. 10.

In some embodiments, at least one of the one to two ribonucleic acids comprises a sequence selected from the group consisting of the ribonucleic acid sequences of FIG. 11. In some embodiments, at least one of the one to two ribonucleic acids comprises a sequence with a single nucleotide mismatch to a sequence selected from the group consisting of the ribonucleic acid sequences of FIG. 11.

In some embodiments, at least one of the one to two ribonucleic acids comprises a sequence selected from the group consisting of the ribonucleic acid sequences of FIG. 12. In some embodiments, at least one of the one to two ribonucleic acids comprises a sequence with a single nucleotide mismatch to a sequence selected from the group consisting of the ribonucleic acid sequences of FIG. 12.

In some embodiments, at least one of the one to two ribonucleic acids comprises a sequence selected from the group consisting of the ribonucleic acid sequences of FIG. 13. In some embodiments, at least one of the one to two ribonucleic acids comprises a sequence with a single nucleotide mismatch to a sequence selected from the group consisting of the ribonucleic acid sequences of FIG. 13.

In some embodiments, at least one of the one to two ribonucleic acids comprises a sequence selected from the group consisting of the ribonucleic acid sequences of FIG. 14. In some embodiments, at least one of the one to two ribonucleic acids comprises a sequence with a single nucleotide mismatch to a sequence selected from the group consisting of the ribonucleic acid sequences of FIG. 14.

In some embodiments, at least one of the one to two ribonucleic acids comprises a sequence selected from the group consisting of the ribonucleic acid sequences of FIG. 15. In some embodiments, at least one of the one to two ribonucleic acids comprises a sequence with a single nucleotide mismatch to a sequence selected from the group consisting of the ribonucleic acid sequences of FIG. 15.

In some embodiments, the ribonucleic acid sequences of the at least one of the one to two ribonucleic acids described above do not include the 3 nucleotide NGG sequence. For example, if the target site sequence is GATGCTCAGTACAGCCACCTTGG (SEQ ID NO: 5323), the ribonucleic acid sequence of the at least one of the one to two ribonucleic acid sequences is GATGCTCAGTACAGCCACCT (SEQ ID NO: 5324). As another example, if the target sequence is GATGCTCAGTACAGCCACCTTGG (SEQ ID NO: 5325), a ribonucleic acid sequence with a single nucleotide mismatch which does not include the 3 nucleotide NGG sequence is GATGCTGAGTACAGCCACCT (SEQ ID NO: 5326), with the italicized G being the mismatched nucleotide. Those skilled in the art will appreciate, however, that the single nucleotide mismatch can comprise any nucleotide in the ribonucleic acid, e.g., the first nucleotide, the second nucleotide, the third nucleotide, the fourth nucleotide, the fifth nucleotide, the sixth nucleotide, the seventh nucleotide, the eighth nucleotide, the ninth nucleotide, the tenth nucleotide, the eleventh nucleotide, the twelfth nucleotide, the thirteenth nucleotide, the fourteenth nucleotide, the fifteenth nucleotide, the sixteenth nucleotide, the seventeenth nucleotide, the eighteenth nucleotide, the nineteenth nucleotide, or the twentieth nucleotide of the ribonucleic acid.

In some embodiments, the ribonucleic acid sequences of the at least one of the one to two ribonucleic acids described above comprise at least a 12 nucleotide fragment of a ribonucleic acid sequence of any of FIGS. 1-15. In some embodiments, the ribonucleic acid sequences of the at least one of the one to two ribonucleic acids described above comprise at least a 12 nucleotide fragment of a sequence with a single nucleotide mismatch to sequence selected from the group consisting of a ribonucleic acid sequence of any of FIGS. 1-15. In some embodiments, the ribonucleic acid sequences of the at least one of the one to two ribonucleic acids described above comprise at least a 12 nucleotide fragment of a ribonucleic acid sequence of GTAACGGCAGACTTCTCCACAGG (SEQ ID NO: 5321). In some embodiments, the ribonucleic acid sequences of the at least one of the one to two ribonucleic acids described above comprise at least a 12 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one of the one to two ribonucleic acids which comprises at least a 12 nucleotide fragment is GTACAGCCACCT (SEQ ID NO: 5327).

In some embodiments, the ribonucleic acid sequences of the at least one of the one to two ribonucleic acids described above comprise at least a 13 nucleotide fragment of a ribonucleic acid sequence of any of FIGS. 1-15. In some embodiments, the ribonucleic acid sequences of the at least one of the one to two ribonucleic acids described above comprise at least a 13 nucleotide fragment of a sequence with a single nucleotide mismatch to a sequence selected from the group consisting of a ribonucleic acid sequence of any of FIGS. 1-15 In some embodiments, the ribonucleic acid sequences of the at least one of the one to two ribonucleic acids described above comprise at least a 13 nucleotide fragment of a ribonucleic acid sequence of GTAACGGCAGACTTCTCCACAGG (SEQ ID NO: 5321). In some embodiments, the ribonucleic acid sequences of the at least one of the one to two ribonucleic acids described above comprise at least a 13 nucleotide fragment of a sequence with a single nucleotide mismatch to a ribonucleic acid sequence of GTAACGGCAGACTTCTCACAGG (SEQ ID NO: 5321). For example, if the target sequence is GATGCTCAGTACAGCCACCTTGG (SEQ ID NO: 5323), the ribonucleic acid sequence of the at least one of the one to two ribonucleic acids which comprises at least a 13 nucleotide fragment is AGTACAGCCACCT (SEQ ID NO: 5328).

In some embodiments, the ribonucleic acid sequences of the at least one of the one to two ribonucleic acids described above comprise at least a 14 nucleotide fragment of a ribonucleic acid sequence of any of FIGS. 1-15. In some embodiments, the ribonucleic acid sequences of the at least one of the one to two ribonucleic acids described above comprise at least a 14 nucleotide fragment of a sequence with a single nucleotide mismatch to a sequence selected from the group consisting of a ribonucleic acid sequence of any of FIGS. 1-15. In some embodiments, the ribonucleic acid sequences of the at least one of the one to two ribonucleic acids described above comprise at least 14 nucleotide fragment of a ribonucleic acid sequence of GTAACGGCAGACTTCTCCACAGG (SEQ ID NO: 5321). In some embodiments, the ribonucleic acid sequences of the at least one of the one to two ribonucleic acids described above comprise at least a 14 nucleotide fragment of a sequence with a single nucleotide mismatch to a ribonucleic acid sequence of GTAACGGCAGACTTCTCACAGG (SEQ ID NO: 5321). For example, if the target sequence is GATGCTCAGTACAGCCACCTTGG (SEQ ID NO: 5323), the ribonucleic acid sequence of the at least one of the one to two ribonucleic acids which comprises at least a 14 nucleotide fragment is CAGTACAGCCACCT (SEQ ID NO: 5329).

In some embodiments, the ribonucleic acid sequences of the at least one of the one to two ribonucleic acids described above comprise at least a 15 nucleotide fragment of a ribonucleic acid sequence of any of FIGS. 1-15. In some embodiments, the ribonucleic acid sequences of the at least one of the one to two ribonucleic acids described above comprise at least a 15 nucleotide fragment of a sequence with a single nucleotide mismatch to a sequence selected from the group consisting of a ribonucleic acid sequence of any of FIGS. 1-15. In some embodiments, the ribonucleic acid sequences of the at least one of the one to two ribonucleic acids described above comprise at least a 15 nucleotide fragment of a ribonucleic acid sequence of GTAACGGCAGACTTCTCCACAGG (SEQ ID NO: 5321). In some embodiments, the ribonucleic acid sequences of the at least one of the one to two ribonucleic acids described above comprise at least a 15 nucleotide fragment of a sequence with a single nucleotide mismatch to a ribonucleic acid sequence of GTAACGGCAGACTTCTC-CACAGG (SEQ ID NO: 5321). For example, if the target sequence is GATGCTCAGTACAGCCACCTTGG (SEQ ID NO: 5323), the ribonucleic acid sequence of the at least one of the one to two ribonucleic acids which comprises at least a 15 nucleotide fragment is TCAGTACAGCCACCT (SEQ ID NO: 5330).

In some embodiments, the ribonucleic acid sequences of the at least one of the one to two ribonucleic acids described above comprise at least a 16 nucleotide fragment of a ribonucleic acid sequence of any of FIGS. 1-15. In some embodiments, the ribonucleic acid sequences of the at least one of the one to two ribonucleic acids described above comprise at least a 16 nucleotide fragment of a sequence with a single nucleotide mismatch to a sequence selected from the group consisting of a ribonucleic acid sequence of any of FIGS. 1-15. In some embodiments, the ribonucleic acid sequences of the at least one of the one to two ribonucleic acids described above comprise at least a 16 nucleotide fragment of a ribonucleic acid sequence of GTAACGGCAGACTTCTCCACAGG (SEQ ID NO: 5321). In some embodiments, the ribonucleic acid sequences of the at least one of the one to two ribonucleic acids described above comprise at least a 16 nucleotide fragment of a sequence with a single nucleotide mismatch to a ribonucleic acid sequence of GTAACGGCAGACTTCTC-CACAGG (SEQ ID NO: 5321). For example, if the target sequence is GATGCTCAGTACAGCCACCTTGG (SEQ ID NO: 5323), the ribonucleic acid sequence of the at least one of the one to two ribonucleic acids which comprises at least a 16 nucleotide fragment is CTCAGTACAGCCACCT (SEQ ID NO: 5331).

In some embodiments, the ribonucleic acid sequences of the at least one of the one to two ribonucleic acids described above comprise at least a 17 nucleotide fragment of a ribonucleic acid sequence of any of FIGS. 1-15. In some embodiments, the ribonucleic acid sequences of the at least one of the one to two ribonucleic acids described above comprise at least a 17 nucleotide fragment of a sequence with a single nucleotide mismatch to a sequence selected from the group consisting of a ribonucleic acid sequence of any of FIGS. 1-15. In some embodiments, the ribonucleic acid sequences of the at least one of the one to two ribonucleic acids described above comprise at least a 17 nucleotide fragment of a ribonucleic acid sequence of any of GTAACGGCAGACTTCTCCACAGG (SEQ ID NO: 5321). In some embodiments, the ribonucleic acid sequences of the at least one of the one to two ribonucleic acids described above comprise at least a 17 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one of the one to two ribonucleic acids which comprises at least a 17 nucleotide fragment is GCTCAGTACAGCCACCT (SEQ ID NO: 5332).

In some embodiments, the ribonucleic acid sequences of the at least one of the one to two ribonucleic acids described above comprise at least a 18 nucleotide fragment of a ribonucleic acid sequence of any of FIGS. 1-15. In some embodiments, the ribonucleic acid sequences of the at least one of the one to two ribonucleic acids described above comprise at least a 18 nucleotide fragment of a sequence with a single nucleotide mismatch to a sequence selected from the group consisting of a ribonucleic acid sequence of any of FIGS. 1-15. In some embodiments, the ribonucleic acid sequences of the at least one of the one to two ribonucleic acids described above comprise at least a 18 nucleotide fragment of a ribonucleic acid sequence of GTAACGGCAGACTTCTCCACAGG (SEQ ID NO: 5321). In some embodiments, the ribonucleic acid sequences of the at least one of the one to two ribonucleic acids described above comprise at least a 18 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one of the one to two ribonucleic acids which comprises at least a 18 nucleotide fragment is TGCTCAGTACAGCCACCT (SEQ ID NO: 5333).

In some embodiments, the ribonucleic acid sequences of the at least one of the one to two ribonucleic acids described above comprise at least a 19 nucleotide fragment of a ribonucleic acid sequence of any of FIGS. 1-15. In some embodiments, the ribonucleic acid sequences of the at least one of the one to two ribonucleic acids described above comprise at least a 19 nucleotide fragment of a sequence with a single nucleotide mismatch to a sequence selected from the group consisting of a ribonucleic acid sequence of any of FIGS. 1-15. In some embodiments, the ribonucleic acid sequences of the at least one of the one to two ribonucleic acids described above comprise at least a 19 nucleotide fragment of a ribonucleic acid sequence of GTAACGGCAGACTTCTCCACAGG (SEQ ID NO: 5321). In some embodiments, the ribonucleic acid sequences of the at least one of the one to two ribonucleic acids described above comprise at least a 19 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one of the one to two ribonucleic acids which comprises at least a 19 nucleotide fragment is ATGCTCAGTACAGCCACCT (SEQ ID NO: 5334).

In some embodiments, the ribonucleic acid sequences of the at least one of the one to two ribonucleic acids described above comprise at least a 20 nucleotide fragment of a ribonucleic acid sequence of any of FIGS. 1-15. In some embodiments, the ribonucleic acid sequences of the at least one of the one to two ribonucleic acids described above comprise at least a 20 nucleotide fragment of a sequence with a single nucleotide mismatch to a sequence selected from the group consisting of a ribonucleic acid sequence of any of FIGS. 1-15. In some embodiments, the ribonucleic acid sequences of the at least one of the one to two ribonucleic acids described above comprise at least a 20 nucleotide fragment of a ribonucleic acid sequence of GTAACGGCAGACTTCTCCACAGG (SEQ ID NO: 5321). In some embodiments, the ribonucleic acid sequences of the at least one of the one to two ribonucleic acids described above comprise at least a 20 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one of the one to two ribonucleic acids which comprises at least a 20 nucleotide fragment is GATGCTCAGTACAGCCACCT (SEQ ID NO: 5324).

The present invention also contemplates multiplex genomic editing. Those skilled in the art will appreciate that the description above with respect to genomic editing of a single gene is equally applicable to the multiplex genomic editing embodiments described below.

In another aspect, the present invention provides a method for simultaneously altering multiple target polynucleotide sequences in a cell.

In some embodiments, a method for simultaneously altering multiple target polynucleotide sequences in a cell comprises a method for simultaneously altering multiple target SCID-associated polynucleotides in a cell.

An exemplary method for simultaneously altering multiple target SCID-associated polynucleotide sequences in a cell comprises contacting the SCID-associated polynucleotide sequences with a clustered regularly interspaced short palindromic repeats-associated (Cas) protein and multiple ribonucleic acids, wherein the ribonucleic acids direct Cas protein to and hybridize to target motifs of the target SCID-associated polynucleotide sequences, wherein the target SCID-associated polynucleotide sequences are cleaved. In some embodiments, the efficiency of alteration of cells that express Cas protein is from about 50% to about 80%.

In some embodiments, a method for simultaneously altering multiple target polynucleotide sequences in a cell comprises a method for simultaneously altering multiple target SCD-associated polynucleotides in a cell.

An exemplary method for simultaneously altering multiple target SCD-associated polynucleotide sequences in a cell comprises contacting the SCD-associated polynucleotide sequences with a clustered regularly interspaced short palindromic repeats-associated (Cas) protein and multiple ribonucleic acids, wherein the ribonucleic acids direct Cas protein to and hybridize to target motifs of the target SCD-associated polynucleotide sequences, wherein the target SCD-associated polynucleotide sequences are cleaved. In some embodiments, the efficiency of alteration of cells that express Cas protein is from about 50% to about 80%.

In some embodiments, a method for simultaneously altering multiple target polynucleotide sequences in a cell comprises a method for simultaneously altering multiple target beta thalassemia-associated polynucleotides in a cell.

An exemplary method for simultaneously altering multiple target beta thalassemia-associated polynucleotide sequences in a cell comprises contacting the polynucleotide sequences with a clustered regularly interspaced short palindromic repeats-associated (Cas) protein and multiple ribonucleic acids, wherein the ribonucleic acids direct Cas protein to and hybridize to target motifs of the target beta thalassemia-associated polynucleotide sequences, wherein the target beta thalassemia-associated polynucleotide sequences are cleaved. In some embodiments, the efficiency of alteration of cells that express Cas protein is from about 50% to about 80%.

In yet another aspect, the present invention provides a method for treating or preventing a disorder associated with expression of polynucleotide sequences in a subject.

In some embodiments, a method for treating or preventing a disorder associated with expression of polynucleotide sequences in a subject comprises a method for treating or preventing a disorder associated with expression of SCID-associated polynucleotide sequences in a subject.

An exemplary method for treating or preventing a disorder associated with expression of SCID-associated polynucleotide sequences in a subject comprises (a) altering target SCID-associated polynucleotide sequences in a cell ex vivo by contacting the SCID-associated polynucleotide sequences with a clustered regularly interspaced short palindromic repeats-associated (Cas) protein and multiple ribonucleic acids, wherein the ribonucleic acids direct Cas protein to and hybridize to target motifs of the target SCID-associated polynucleotide sequences, wherein the target SCID-associated polynucleotide sequences are cleaved, and (b) introducing the cell into the subject, thereby treating or preventing a disorder associated with expression of the SCID-associated polynucleotide sequences. In some embodiments, the efficiency of alteration of cells that express Cas protein is from about 50% to about 80%. In some embodiments, the method includes the step of contacting, before the step of introducing the cell into the subject, the cleaved SCID-associated polynucleotide sequences with an exogenously introduced DNA repair template comprising a corresponding wild-type or normal polynucleotide sequence, thereby allowing homology-directed repair to replace the cleaved SCID-associated polynucleotide sequence with the wild-type or normal gene sequence.

In embodiments in which the target SCID-associated polynucleotide sequences comprise ADA polynucleotide sequences, the exogenously introduced DNA repair template comprises a corresponding wild-type or normal ADA polynucleotide sequence.

In embodiments in which the target SCID-associated polynucleotide sequences comprise AK2 polynucleotide sequences, the exogenously introduced DNA repair template comprises a corresponding wild-type or normal AK2 polynucleotide sequence.

In embodiments in which the target SCID-associated polynucleotide sequences comprise CD3D polynucleotide sequences, the exogenously introduced DNA repair template comprises a corresponding wild-type or normal CD3D polynucleotide sequence.

In embodiments in which the target SCID-associated polynucleotide sequences comprise DCLRE1C polynucleotide sequences, the exogenously introduced DNA repair template comprises a corresponding wild-type or normal DCLRE1C polynucleotide sequence.

In embodiments in which the target SCID-associated polynucleotide sequences comprise IL2RG polynucleotide sequences, the exogenously introduced DNA repair template comprises a corresponding wild-type or normal IL2RG polynucleotide sequence.

In embodiments in which the target SCID-associated polynucleotide sequences comprise IL7R polynucleotide sequences, the exogenously introduced DNA repair template comprises a corresponding wild-type or normal IL7R polynucleotide sequence.

In embodiments in which the target SCID-associated polynucleotide sequences comprise JAK3 polynucleotide sequences, the exogenously introduced DNA repair template comprises a corresponding wild-type or normal JAK3 polynucleotide sequence.

In embodiments in which the target SCID-associated polynucleotide sequences comprise LIG4 polynucleotide sequences, the exogenously introduced DNA repair template comprises a corresponding wild-type or normal L1G4 polynucleotide sequence.

In embodiments in which the target SCID-associated polynucleotide sequences comprise NHEJ1 polynucleotide sequences, the exogenously introduced DNA repair template comprises a corresponding wild-type or normal NHEJ1 polynucleotide sequence.

In embodiments in which the target SCID-associated polynucleotide sequences comprise PNP polynucleotide sequences, the exogenously introduced DNA repair template comprises a corresponding wild-type or normal PNP polynucleotide sequence.

In embodiments in which the target SCID-associated polynucleotide sequences comprise PRKDC polynucleotide sequences, the exogenously introduced DNA repair template comprises a corresponding wild-type or normal PRKDC polynucleotide sequence.

In embodiments in which the target SCID-associated polynucleotide sequences comprise RAG1 polynucleotide sequences, the exogenously introduced DNA repair template comprises a corresponding wild-type or normal RAG1 polynucleotide sequence.

In embodiments in which the target SCID-associated polynucleotide sequences comprise RAG2 polynucleotide sequences, the exogenously introduced DNA repair template comprises a corresponding wild-type or normal RAG2 polynucleotide sequence.

In embodiments in which the target SCID-associated polynucleotide sequences comprise ZAP70 polynucleotide sequences, the exogenously introduced DNA repair template comprises a corresponding wild-type or normal ZAP70 polynucleotide sequence.

In some embodiments, a method for treating or preventing a disorder associated with expression of polynucleotide sequences in a subject comprises a method for treating or preventing a disorder associated with expression of SCD-associated polynucleotide sequences in a subject.

An exemplary method for treating or preventing a disorder associated with expression of SCD-associated polynucleotide sequences in a subject comprises (a) altering target SCD-associated polynucleotide sequences in a cell ex vivo by contacting the SCD-associated polynucleotide sequences with a clustered regularly interspaced short palindromic repeats-associated (Cas) protein and multiple ribonucleic acids, wherein the ribonucleic acids direct Cas protein to and hybridize to target motifs of the target SCD-associated polynucleotide sequences, wherein the target SCD-associated polynucleotide sequences are cleaved, and (b) introducing the cell into the subject, thereby treating or preventing a disorder associated with expression of the SCD-associated polynucleotide sequences. In some embodiments, the efficiency of alteration of cells that express Cas protein is from about 50% to about 80%. In some embodiments, the method includes the step of contacting, before the step of introducing the cell into the subject, the cleaved SCD-associated polynucleotide sequences with an exogenously introduced DNA repair template comprising a normal HBB sequence, thereby allowing homology-directed repair to replace the cleaved SCD-associated polynucleotide sequence with the normal HBB sequence.

In some embodiments, a method for treating or preventing a disorder associated with expression of polynucleotide sequences in a subject comprises a method for treating or preventing a disorder associated with expression of beta thalassemia-associated polynucleotide sequences in a subject.

An exemplary method for treating or preventing a disorder associated with expression of beta thalassemia-associated polynucleotide sequences in a subject comprises (a) altering target beta thalassemia-associated polynucleotide sequences in a cell ex vivo by contacting the beta thalassemia-associated polynucleotide sequences with a clustered regularly interspaced short palindromic repeats-associated (Cas) protein and multiple ribonucleic acids, wherein the ribonucleic acids direct Cas protein to and hybridize to target motifs of the target beta thalassemia-associated polynucleotide sequences, wherein the target beta thalassemia-associated polynucleotide sequences are cleaved, and (b) introducing the cell into the subject, thereby treating or preventing a disorder associated with expression of the beta thalassemia-associated polynucleotide sequences. In some embodiments, the efficiency of alteration of cells that express Cas protein is from about 50% to about 80%, In some embodiments, the method includes the step of contacting, before the step of introducing the cell into the subject, the cleaved beta thalassemia-associated polynucleotide sequences with an exogenously introduced DNA repair template comprising a normal HBB sequence, thereby allowing homology-directed repair to replace the cleaved beta thalassemia-associated polynucleotide sequence with the normal HBB sequence.

As used herein, the terms "administering," "introducing" and "transplanting" are used interchangeably in the context of the placement of cells, e.g. cells described herein comprising a target polynucleotide sequence altered according to the methods of the invention into a subject, by a method or route which results in at least partial localization of the introduced cells at a desired site. The cells can be implanted directly to the desired site, or alternatively be administered by any appropriate route which results in delivery to a desired location in the subject where at least a portion of the implanted cells or components of the cells remain viable. The period of viability of the cells after administration to a subject can be as short as a few hours, e. g. twenty-four hours, to a few days, to as long as several years. In some instances, the cells can also be administered a location other than the desired site, such as in the liver or subcutaneously, for example, in a capsule to maintain the implanted cells at the implant location and avoid migration of the implanted cells.

For ex vivo methods, cells can include autologous cells, i.e., a cell or cells taken from a subject who is in need of altering a target polynucleotide sequence in the cell or cells (i.e., the donor and recipient are the same individual). Autologous cells have the advantage of avoiding any immunologically-based rejection of the cells. Alternatively, the cells can be heterologous, e.g., taken from a donor. The second subject can be of the same or different species. Typically, when the cells come from a donor, they will be from a donor who is sufficiently immunologically compatible with the recipient, i.e., will not be subject to transplant rejection, to lessen or remove the need for immunosuppression. In some embodiments, the cells are taken from a xenogeneic source, i.e., a non-human mammal that has been genetically engineered to be sufficiently immunologically compatible with the recipient, or the recipient's species. Methods for determining immunological compatibility are known in the art, and include tissue typing to assess donor-recipient compatibility for HLA and ABO determinants. See, e.g., *Transplantation Immunology*, Bach and Auchincloss, Eds. (Wiley, John & Sons, Incorporated 1994).

Any suitable cell culture media can be used for ex vivo methods of the invention.

Another exemplary method for treating or preventing a disorder associated with expression of SCID-associated polynucleotide sequences in a subject comprises altering target SCID-associated polynucleotide sequences in a cell by contacting the SCID-associated polynucleotide sequences with a clustered regularly interspaced short palindromic repeats-associated (Cas) protein and multiple ribonucleic acids, wherein the ribonucleic acids direct Cas protein to and hybridize to target moieties of the target SCID-associated polynucleotide sequences, and wherein the target SCID-associated polynucleotide sequences are cleaved, thereby treating or preventing a disorder associated with expression of the polynucleotide sequences.

In some embodiments, the method includes the step of contacting the cleaved SCID-associated polynucleotide sequences with an exogenously introduced DNA repair template comprising a corresponding wild-type or normal polynucleotide sequence, thereby allowing homology-directed repair to replace the cleaved SCID-associated polynucleotide sequence with the corresponding wild-type or normal polynucleotide sequence.

In embodiments in which the target SCID-associated polynucleotide sequences comprise ADA polynucleotide sequences, the exogenously introduced DNA repair template comprises a corresponding wild-type or normal ADA polynucleotide sequence.

In embodiments in which the target SCID-associated polynucleotide sequences comprise AK2 polynucleotide sequences, the exogenously introduced DNA repair template comprises a corresponding wild-type or normal AK2 polynucleotide sequence.

In embodiments in which the target SCID-associated polynucleotide sequences comprise CD3D polynucleotide sequences, the exogenously introduced DNA repair template comprises a corresponding wild-type or normal CD3D polynucleotide sequence.

In embodiments in which the target SCID-associated polynucleotide sequences comprise DCLRE1C polynucleotide sequences, the exogenously introduced DNA repair template comprises a corresponding wild-type or normal DCLRE1C polynucleotide sequence.

In embodiments in which the target SCID-associated polynucleotide sequences comprise IL2RG polynucleotide sequences, the exogenously introduced DNA repair template comprises a corresponding wild-type or normal IL2RG polynucleotide sequence.

In embodiments in which the target SCID-associated polynucleotide sequences comprise IL7R polynucleotide sequences, the exogenously introduced DNA repair template comprises a corresponding wild-type or normal IL7R polynucleotide sequence.

In embodiments in which the target SCID-associated polynucleotide sequences comprise JAK3 polynucleotide sequences, the exogenously introduced DNA repair template comprises a corresponding wild-type or normal JAK3 polynucleotide sequence.

In embodiments in which the target SCID-associated polynucleotide sequences comprise LIG4 polynucleotide sequences, the exogenously introduced DNA repair template comprises a corresponding wild-type or normal LIG4 polynucleotide sequence.

In embodiments in which the target SCID-associated polynucleotide sequences comprise NHEJ1 polynucleotide sequences, the exogenously introduced DNA repair template comprises a corresponding wild-type or normal NHEJ1 polynucleotide sequence.

In embodiments in which the target SCID-associated polynucleotide sequences comprise PNP polynucleotide sequences, the exogenously introduced DNA repair template comprises a corresponding wild-type or normal PNP polynucleotide sequence.

In embodiments in which the target SCID-associated polynucleotide sequences comprise PRKDC polynucleotide sequences, the exogenously introduced DNA repair template comprises a corresponding wild-type or normal PRKDC polynucleotide sequence.

In embodiments in which the target SCID-associated polynucleotide sequences comprise RAG1 polynucleotide sequences, the exogenously introduced DNA repair template comprises a corresponding wild-type or normal RAG1 polynucleotide sequence.

In embodiments in which the target SCID-associated polynucleotide sequences comprise RAG2 polynucleotide sequences, the exogenously introduced DNA repair template comprises a corresponding wild-type or normal RAG2 polynucleotide sequence.

In embodiments in which the target SCID-associated polynucleotide sequences comprise ZAP70 polynucleotide sequences, the exogenously introduced DNA repair template comprises a corresponding wild-type or normal ZAP70 polynucleotide sequence.

Another exemplary method for treating or preventing a disorder associated with expression of SCD-associated polynucleotide sequences in a subject comprises altering target SCD-associated polynucleotide sequences in a cell by contacting the SCD-associated polynucleotide sequences with a clustered regularly interspaced short palindromic repeats-associated (Cas) protein and multiple ribonucleic acids, wherein the ribonucleic acids direct Cas protein to and hybridize to target moieties of the target SCD-associated polynucleotide sequences, and wherein the target SCD-associated polynucleotide sequences are cleaved, thereby treating or preventing a disorder associated with expression of the polynucleotide sequences.

In some embodiments, the method includes the step of contacting the cleaved SCD-associated polynucleotide sequences with an exogenously introduced DNA repair template comprising a normal HBB sequence, thereby allowing homology-directed repair to replace the cleaved SCD-associated polynucleotide sequence with the normal HBB sequence.

Another exemplary method for treating or preventing a disorder associated with expression of beta thalassemia-associated polynucleotide sequences in a subject comprises altering target beta thalassemia-associated polynucleotide sequences in a cell by contacting the beta thalassemia-associated polynucleotide sequences with a clustered regularly interspaced short palindromic repeats-associated (Cas) protein and multiple ribonucleic acids, wherein the ribonucleic acids direct Cas protein to and hybridize to target moieties of the target beta thalassemia-associated polynucleotide sequences, and wherein the target beta thalassemia-associated polynucleotide sequences are cleaved, thereby treating or preventing a disorder associated with expression of the beta thalassemia-associated polynucleotide sequences.

In some embodiments, the method includes the step of contacting the cleaved beta thalassemia-associated polynucleotide sequences with an exogenously introduced DNA repair template comprising a normal HBB sequence, thereby allowing homology-directed repair to replace the cleaved beta thalassemia-associated polynucleotide sequence with the normal HBB sequence.

The terms "subject" and "individual" are used interchangeably herein, and refer to an animal, for example, a human from whom cells can be obtained and/or to whom treatment, including prophylactic treatment, with the cells as described herein, is provided. For treatment of those infections, conditions or disease states which are specific for a specific animal such as a human subject, the term subject refers to that specific animal. The "non-human animals" and "non-human mammals" as used interchangeably herein, includes mammals such as rats, mice, rabbits, sheep, cats, dogs, cows, pigs, and non-human primates. The term "subject" also encompasses any vertebrate including but not limited to mammals, reptiles, amphibians and fish. However, advantageously, the subject is a mammal such as a human, or other mammals such as a domesticated mammal, e.g. dog, cat, horse, and the like, or production mammal, e.g. cow, sheep, pig, and the like.

In some embodiments, the alteration results in reduced expression of the target polynucleotide sequences. In exemplary embodiments, the alteration results in reduced expression of the target SCID-associated polynucleotide sequences. In exemplary embodiments, the alteration results in reduced expression of the target ADA polynucleotide sequences. In exemplary embodiments, the alteration results in reduced expression of the target AK2 polynucleotide sequences. In exemplary embodiments, the alteration results in reduced expression of the target CD3D polynucleotide sequences. In exemplary embodiments, the alteration results in reduced expression of the target DCLRE1C polynucleotide sequences. In exemplary embodiments, the alteration results in reduced expression of the target IL2RG polynucleotide sequences. In exemplary embodiments, the alteration results in reduced expression of the target IL7R polynucleotide sequences. In exemplary embodiments, the alteration results in reduced expression of the target JAK3 polynucleotide sequences. In exemplary embodiments, the alteration results in reduced expression of the target LIG4 polynucleotide sequences. In exemplary embodiments, the alteration results in reduced expression of the target NHEJ1 polynucleotide sequences. In exemplary embodiments, the alteration results in reduced expression of the target PNP polynucleotide sequences. In exemplary embodiments, the alteration results in reduced expression of the target PRKDC polynucleotide sequences. In exemplary embodiments, the alteration results in reduced expression of the target RAG1 polynucleotide sequences. In exemplary embodiments, the alteration results in reduced expression of the target RAG2 polynucleotide sequences. In exemplary embodiments, the alteration results in reduced expression of the target ZAP70 polynucleotide sequences. In exemplary embodiments, the alteration results in reduced expression of the target SCD-associated polynucleotide sequences. In exemplary embodiments, the alteration results in reduced expression of the target beta thalassemia-associated polynucleotide sequences. In some embodiments, the alteration results in a knock out of the target polynucleotide sequences. In exemplary embodiments, the alteration results in a knock out of the target SCID-associated polynucleotide sequences. In exemplary embodiments, the alteration results in a knock out of the target ADA polynucleotide sequences. In exemplary embodiments, the alteration results in a knock out of the target AK2 polynucleotide sequences. In exemplary embodiments, the alteration results in a knock out of the target CD3D polynucleotide sequences. In exemplary embodiments, the alteration results in a knock out of the target DCLRE1C polynucleotide sequences. In exemplary embodiments, the alteration results in a knock out of the target IL2RG polynucleotide sequences. In exemplary embodiments, the alteration results in a knock out of the target IL7R polynucleotide sequences. In exemplary embodiments, the alteration results in a knock out of the target JAK3 polynucleotide sequences. In exemplary embodiments, the alteration results in a knock out of the target LIG4 polynucleotide sequences. In exemplary embodiments, the alteration results in a knock out of the target NHEJ1 polynucleotide sequences. In exemplary embodiments, the alteration results in a knock out of the target PNP polynucleotide sequences. In exemplary embodiments, the alteration results in a knock out of the target PRKDC polynucleotide sequences. In exemplary embodiments, the alteration results in a knock out of the target RAG1 polynucleotide sequences. In exemplary embodiments, the alteration results in a knock out of the target RAG2 polynucleotide sequences. In exemplary embodiments, the alteration results in a knock out of the target ZAP70 polynucleotide sequences. In exemplary embodiments, the alteration results in a knock out of the target SCD-associated polynucleotide sequences. In exemplary embodiments, the alteration results in a knock out of the target beta thalassemia-associated polynucleotide sequences.

In some embodiments, the alteration results in correction of the target polynucleotide sequences from undesired sequences to desired sequences. In exemplary embodiments, the alteration results in correction of the target SCID-associated polynucleotide sequences to corresponding normal wild-type polynucleotide sequences. In exemplary embodiments, the alteration results in correction of the target SCID-associated polynucleotide sequences to corresponding normal wild-type ADA sequences. In exemplary embodiments, the alteration results in correction of the target SCID-associated polynucleotide sequences to corresponding normal wild-type AK2 sequences. In exemplary embodiments, the alteration results in correction of the target SCID-associated polynucleotide sequences to corresponding normal wild-type CD3D sequences. In exemplary embodiments, the alteration results in correction of the target SCID-associated polynucleotide sequences to corresponding normal wild-type DCLRE1C sequences. In exemplary embodiments, the alteration results in correction of the target SCID-associated polynucleotide sequences to corresponding normal wild-type IL2RG sequences. In exemplary embodiments, the alteration results in correction of the target SCID-associated polynucleotide sequences to corresponding normal wild-type IL7R sequences. In exemplary embodiments, the alteration results in correction of the target SCID-associated polynucleotide sequences to corresponding normal wild-type JAK3 sequences. In exemplary embodiments, the alteration results in correction of the target SCID-associated polynucleotide sequences to corresponding normal wild-type LIG4 sequences. In exemplary embodiments, the alteration results in correction of the target SCID-associated polynucleotide sequences to corresponding normal wild-type NHEJ1 sequences. In exemplary embodiments, the alteration results in correction of the target SCID-associated polynucleotide sequences to corresponding normal wild-type PNP sequences. In exemplary embodiments, the alteration results in correction of the target SCID-associated polynucleotide sequences to corresponding normal wild-type PRKDC sequences. In exemplary embodiments, the alteration results in correction of the target SCID-associated polynucleotide sequences to corresponding normal wild-type RAG1 sequences. In exemplary embodiments, the alteration results in correction of the target SCID-associated polynucleotide sequences to corresponding normal wild-type RAG2 sequences. In exemplary embodiments, the alteration results in correction of the target SCID-associated polynucleotide sequences to corresponding normal wild-type ZAP70 sequences. In exemplary embodiments, the alteration results in correction of the target SCD-associated polynucleotide sequences to normal wild-type HBB sequences. In exemplary embodiments, the alteration results in correction of the target beta thalassemia-associated polynucleotide sequences to normal wild-type HBB sequences. In some embodiments, each alteration is a homozygous alteration. In some embodiments, the efficiency of alteration at each loci is from about 5% to about 80%. In some embodiments, the efficiency of alteration at each loci is from about 10% to about 80%. In some embodiments, the efficiency of alteration at each loci is from about 30% to about 80%. In some embodiments, the efficiency of alteration at each loci is from about 50% to about 80%. In some embodiments, the efficiency of alteration at each loci is from greater than or equal to about 80%.

In some embodiments, each target polynucleotide sequence is cleaved such that a double-strand break results. In some embodiments, each target polynucleotide sequence is cleaved such that a single-strand break results.

In some embodiments, the target polynucleotide sequences comprise multiple different portions of ADA (e.g., one or more mutations in the ADA gene). In some embodiments, the target polynucleotide sequences comprise at least a portion of ADA.

In some embodiments, the target polynucleotide sequences comprise multiple different portions of AK2 (e.g., one or more mutations in the AK2 gene). In some embodiments, the target polynucleotide sequences comprise at least a portion of AK2.

In some embodiments, the target polynucleotide sequences comprise multiple different portions of CD3D (e.g., one or more mutations in the CD3D gene). In some embodiments, the target polynucleotide sequences comprise at least a portion of CD3D.

In some embodiments, the target polynucleotide sequences comprise multiple different portions of DCLRE1C (e.g., one or more mutations in the DCLRE1C gene). In some embodiments, the target polynucleotide sequences comprise at least a portion of DCLRE1C.

In some embodiments, the target polynucleotide sequences comprise multiple different portions of IL2RG (e.g., one or more mutations in the IL2RG gene). In some embodiments, the target polynucleotide sequences comprise at least a portion of IL2RG.

In some embodiments, the target polynucleotide sequences comprise multiple different portions of IL7R (e.g., one or more mutations in the IL7R gene). In some embodiments, the target polynucleotide sequences comprise at least a portion of IL7R.

In some embodiments, the target polynucleotide sequences comprise multiple different portions of JAK3

(e.g., one or more mutations in the JAK3 gene). In some embodiments, the target polynucleotide sequences comprise at least a portion of JAK3.

In some embodiments, the target polynucleotide sequences comprise multiple different portions of LIG4 (e.g., one or more mutations in the LIG4 gene). In some embodiments, the target polynucleotide sequences comprise at least a portion of LIG4.

In some embodiments, the target polynucleotide sequences comprise multiple different portions of NHEJ1 (e.g., one or more mutations in the NHEJ1 gene). In some embodiments, the target polynucleotide sequences comprise at least a portion of NHEJ1.

In some embodiments, the target polynucleotide sequences comprise multiple different portions of PNP (e.g., one or more mutations in the PNP gene). In some embodiments, the target polynucleotide sequences comprise at least a portion of PNP.

In some embodiments, the target polynucleotide sequences comprise multiple different portions of PRKDC (e.g., one or more mutations in the PRKDC gene). In some embodiments, the target polynucleotide sequences comprise at least a portion of PRKDC.

In some embodiments, the target polynucleotide sequences comprise multiple different portions of RAG1 (e.g., one or more mutations in the RAG1 gene). In some embodiments, the target polynucleotide sequences comprise at least a portion of RAG1.

In some embodiments, the target polynucleotide sequences comprise multiple different portions of RAG2 (e.g., one or more mutations in the RAG2 gene). In some embodiments, the target polynucleotide sequences comprise at least a portion of RAG2.

In some embodiments, the target polynucleotide sequences comprise multiple different portions of ZAP70 (e.g., one or more mutations in the ZAP70 gene). In some embodiments, the target polynucleotide sequences comprise at least a portion of ZAP70.

In some embodiments, the target polynucleotide sequences comprise multiple different portions of HBB (e.g., one or more mutations in the HBB gene). In some embodiments, the target polynucleotide sequences comprise at least a portion of HBB.

In some embodiments, each target motif is a 20-nucleotide DNA sequence. In some embodiments, each target motif is a 20-nucleotide DNA sequence beginning with G and immediately precedes an NGG motif recognized by the Cas protein. In some embodiments, each target motif is a 20-nucleotide DNA sequence and immediately precedes an NGG motif recognized by the Cas protein. In some embodiments, each target motif is G(N)19NGG. In some embodiments, each target motif is (N)20NGG. In some embodiments, each target motif is selected such that it contains at least two mismatches when compared with all other genomic nucleotide sequences in the cell. In some embodiments, each target motif is selected such that it contains at least two mismatches when compared with all other genomic nucleotide sequences in the cell.

In some embodiments, subsequent to cleavage of the target polynucleotide sequences, homology-directed repair occurs. In some embodiments, homology-directed repair is performed using an exogenously introduced DNA repair template. In some embodiments, the exogenously introduced DNA repair template is single-stranded. In some embodiments, the exogenously introduced DNA repair template is double-stranded.

In some embodiments, the exogenously introduced DNA repair template is a normal or wild-type ADA sequence. In some embodiments, the exogenously introduced DNA repair template is a normal or wild-type ADA sequence corresponding to the mutant ADA sequence comprising the SCID-associated polynucleotide sequence.)

In some embodiments, the exogenously introduced DNA repair template is a normal or wild-type AK2 sequence. In some embodiments, the exogenously introduced DNA repair template is a normal or wild-type AK2 sequence corresponding to the mutant AK2 sequence comprising the SCID-associated polynucleotide sequence.

In some embodiments, the exogenously introduced DNA repair template is a normal or wild-type CD3D sequence. In some embodiments, the exogenously introduced DNA repair template is a normal or wild-type CD3D sequence corresponding to the mutant CD3D sequence comprising the SCID-associated polynucleotide sequence.

In some embodiments, the exogenously introduced DNA repair template is a normal or wild-type DCLREIC sequence. In some embodiments, the exogenously introduced DNA repair template is a normal or wild-type DCLRE1C sequence corresponding to the mutant DCLREIC sequence comprising the SCID-associated polynucleotide sequence.

In some embodiments, the exogenously introduced DNA repair template is a normal or wild-type IL2RG sequence. In some embodiments, the exogenously introduced DNA repair template is a normal or wild-type IL2RG sequence corresponding to the mutant IL2RG sequence comprising the SCID-associated polynucleotide sequence.

In some embodiments, the exogenously introduced DNA repair template is a normal or wild-type IL7R sequence. In some embodiments, the exogenously introduced DNA repair template is a normal or wild-type IL7R sequence corresponding to the mutant IL7R sequence comprising the SCID-associated polynucleotide sequence.

In some embodiments, the exogenously introduced DNA repair template is a normal or wild-type JAK3 sequence. In some embodiments, the exogenously introduced DNA repair template is a normal or wild-type JAK3 sequence corresponding to the mutant JAK3 sequence comprising the SCID-associated polynucleotide sequence.

In some embodiments, the exogenously introduced DNA repair template is a normal or wild-type LIG4 sequence. In some embodiments, the exogenously introduced DNA repair template is a normal or wild-type LIG4 sequence corresponding to the mutant LIG4 sequence comprising the SCID-associated polynucleotide sequence.

In some embodiments, the exogenously introduced DNA repair template is a normal or wild-type NHEJ1 sequence. In some embodiments, the exogenously introduced DNA repair template is a normal or wild-type NHEJ1 sequence corresponding to the mutant NHEJ1 sequence comprising the SCID-associated polynucleotide sequence.

In some embodiments, the exogenously introduced DNA repair template is a normal or wild-type PNP sequence. In some embodiments, the exogenously introduced DNA repair template is a normal or wild-type PNP sequence corresponding to the mutant PNP sequence comprising the SCID-associated polynucleotide sequence.

In some embodiments, the exogenously introduced DNA repair template is a normal or wild-type PRKDC sequence. In some embodiments, the exogenously introduced DNA repair template is a normal or wild-type PRKDC sequence corresponding to the mutant PRKDC sequence comprising the SCID-associated polynucleotide sequence.

In some embodiments, the exogenously introduced DNA repair template is a normal or wild-type RAG1 sequence. In some embodiments, the exogenously introduced DNA repair template is a normal or wild-type RAG1 sequence corresponding to the mutant RAG1 sequence comprising the SCID-associated polynucleotide sequence.

In some embodiments, the exogenously introduced DNA repair template is a normal or wild-type RAG2 sequence. In some embodiments, the exogenously introduced DNA repair template is a normal or wild-type RAG2 sequence corresponding to the mutant RAG2 sequence comprising the SCID-associated polynucleotide sequence.

In some embodiments, the exogenously introduced DNA repair template is a normal or wild-type ZAP70 sequence. In some embodiments, the exogenously introduced DNA repair template is a normal or wild-type ZAP70 sequence corresponding to the mutant ZAP70 sequence comprising the SCID-associated polynucleotide sequence.

In some embodiments, the exogenously introduced DNA repair template is a normal or wild-type HBB sequence. In some embodiments, the exogenously introduced DNA repair template is a normal or wild-type HBB sequence corresponding to the mutant HBB sequence comprising the SCD-associated polynucleotide sequence. In some embodiments, the exogenously introduced DNA repair template is a normal or wild-type HBB sequence corresponding to the mutant HBB sequence comprising the beta thalassemia-associated polynucleotide sequence.

In some embodiments, the Cas protein (e.g., Cas9) is complexed with the multiple ribonucleic acids. In some embodiments, the Cas protein and the multiple ribonucleic acids are contained in nanoparticles, as described herein. In some embodiments, the Cas protein and the multiple ribonucleic acids are contained in lipid nanoparticles, as described herein. In some embodiments, a nucleic acid encoding a Cas protein and the multiple ribonucleic acids are contained in nanoparticles. In some embodiments, a nucleic acid encoding a Cas protein and the multiple ribonucleic acids are contained in lipid nanoparticles, as described herein. In some embodiments, a modified, synthetic mRNA encoding a Cas protein as described herein, and multiple ribonucleic acids at least one of which comprises a modified, synthetic RNA as described herein, are contained in lipid nanoparticles. In some embodiments, a modified, synthetic mRNA encoding a Cas9 protein as described herein, and multiple ribonucleic acids at least one of which comprises a modified, synthetic RNA as described herein, are contained in lipid nanoparticles.

In some embodiments, the multiple ribonucleic acids are selected to minimize hybridization with nucleic acid sequences other than the target polynucleotide sequence (e.g., multiple alterations of a single target polynucleotide sequence). In some embodiments, the multiple ribonucleic acids are selected to minimize hybridization with nucleic acid sequences other than the target polynucleotide sequences (e.g., one or more alterations of multiple target polynucleotide sequences). In some embodiments, each of the multiple ribonucleic acids hybridize to target motifs that contain at least two mismatches when compared with all other genomic nucleotide sequences in the cell. In some embodiments, each of the multiple ribonucleic acids hybridize to target motifs that contain at least one mismatch when compared with all other genomic nucleotide sequences in the cell. In some embodiments, each of the multiple ribonucleic acids are designed to hybridize to target motifs immediately adjacent to deoxyribonucleic acid motifs recognized by the Cas protein. In some embodiments, each of the multiple ribonucleic acids are designed to hybridize to target motifs immediately adjacent to deoxyribonucleic acid motifs recognized by the Cas protein which flank mutant alleles located between the target motifs.

In some embodiments, each of the multiple ribonucleic acids comprises a different sequence selected from the group consisting of the ribonucleic acid sequences of FIG. 1. In some embodiments, each of the multiple ribonucleic acids comprises a sequence with a single nucleotide mismatch to a different sequence selected from the group consisting of the ribonucleic acid sequences of FIG. 1.

In some embodiments, each of the multiple ribonucleic acids comprises a different sequence selected from the group consisting of the ribonucleic acid sequences of FIG. 2. In some embodiments, each of the multiple ribonucleic acids comprises a sequence with a single nucleotide mismatch to a different sequence selected from the group consisting of the ribonucleic acid sequences of FIG. 2.

In some embodiments, each of the multiple ribonucleic acids comprises a different sequence selected from the group consisting of the ribonucleic acid sequences of FIG. 3. In some embodiments, each of the multiple ribonucleic acids comprises a sequence with a single nucleotide mismatch to a different sequence selected from the group consisting of the ribonucleic acid sequences of FIG. 3.

In some embodiments, each of the multiple ribonucleic acids comprises a different sequence selected from the group consisting of the ribonucleic acid sequences of FIG. 4. In some embodiments, each of the multiple ribonucleic acids comprises a sequence with a single nucleotide mismatch to a different sequence selected from the group consisting of the ribonucleic acid sequences of FIG. 4.

In some embodiments, each of the multiple ribonucleic acids comprises a different sequence selected from the group consisting of the ribonucleic acid sequences of FIG. 5. In some embodiments, each of the multiple ribonucleic acids comprises a sequence with a single nucleotide mismatch to a different sequence selected from the group consisting of the ribonucleic acid sequences of FIG. 5.

In some embodiments, each of the multiple ribonucleic acids comprises a different sequence selected from the group consisting of the ribonucleic acid sequences of FIG. 6. In some embodiments, each of the multiple ribonucleic acids comprises a sequence with a single nucleotide mismatch to a different sequence selected from the group consisting of the ribonucleic acid sequences of FIG. 6.

In some embodiments, each of the multiple ribonucleic acids comprises a different sequence selected from the group consisting of the ribonucleic acid sequences of FIG. 7. In some embodiments, each of the multiple ribonucleic acids comprises a sequence with a single nucleotide mismatch to a different sequence selected from the group consisting of the ribonucleic acid sequences of FIG. 7.

In some embodiments, each of the multiple ribonucleic acids comprises a different sequence selected from the group consisting of the ribonucleic acid sequences of FIG. 8. In some embodiments, each of the multiple ribonucleic acids comprises a sequence with a single nucleotide mismatch to a different sequence selected from the group consisting of the ribonucleic acid sequences of FIG. 8.

In some embodiments, each of the multiple ribonucleic acids comprises a different sequence selected from the group consisting of the ribonucleic acid sequences of FIG. 9. In some embodiments, each of the multiple ribonucleic acids comprises a sequence with a single nucleotide mismatch to a different sequence selected from the group consisting of the ribonucleic acid sequences of FIG. 9.

In some embodiments, each of the multiple ribonucleic acids comprises a different sequence selected from the group consisting of the ribonucleic acid sequences of FIG. 9. In some embodiments, each of the multiple ribonucleic acids comprises a sequence with a single nucleotide mismatch to a different sequence selected from the group consisting of the ribonucleic acid sequences of FIG. 9.

In some embodiments, each of the multiple ribonucleic acids comprises a different sequence selected from the group consisting of the ribonucleic acid sequences of FIG. 10. In some embodiments, each of the multiple ribonucleic acids comprises a sequence with a single nucleotide mismatch to a different sequence selected from the group consisting of the ribonucleic acid sequences of FIG. 10.

In some embodiments, each of the multiple ribonucleic acids comprises a different sequence selected from the group consisting of the ribonucleic acid sequences of FIG. 11. In some embodiments, each of the multiple ribonucleic acids comprises a sequence with a single nucleotide mismatch to a different sequence selected from the group consisting of the ribonucleic acid sequences of FIG. 11.

In some embodiments, each of the multiple ribonucleic acids comprises a different sequence selected from the group consisting of the ribonucleic acid sequences of FIG. 12. In some embodiments, each of the multiple ribonucleic acids comprises a sequence with a single nucleotide mismatch to a different sequence selected from the group consisting of the ribonucleic acid sequences of FIG. 12.

In some embodiments, each of the multiple ribonucleic acids comprises a different sequence selected from the group consisting of the ribonucleic acid sequences of FIG. 13. In some embodiments, each of the multiple ribonucleic acids comprises a sequence with a single nucleotide mismatch to a different sequence selected from the group consisting of the ribonucleic acid sequences of FIG. 13.

In some embodiments, each of the multiple ribonucleic acids comprises a different sequence selected from the group consisting of the ribonucleic acid sequences of FIG. 14. In some embodiments, each of the multiple ribonucleic acids comprises a sequence with a single nucleotide mismatch to a different sequence selected from the group consisting of the ribonucleic acid sequences of FIG. 14.

In some embodiments, each of the multiple ribonucleic acids comprises a different sequence selected from the group consisting of the ribonucleic acid sequences of FIG. 15. In some embodiments, each of the multiple ribonucleic acids comprises a sequence with a single nucleotide mismatch to a different sequence selected from the group consisting of the ribonucleic acid sequences of FIG. 15.

In some embodiments, each of the multiple ribonucleic acids comprises a different sequence selected from the group consisting of the ribonucleic acid sequences of FIGS. 1-15 and combinations thereof. In some embodiments, the different sequences of the multiple ribonucleic acids described above do not include the 3 nucleotide NGG sequence.

For example, if a target site sequence is GATGCTCAGTACAGCCACCTTGG (SEQ ID NO: 5323), a sequence of the multiple ribonucleic acids is GATGCTCAGTACAGCCACCT (SEQ ID NO: 5324). As another example, if the target sequence is GATGCTCAGTACAGCCACCTTGG (SEQ ID NO: 5323), a sequence with a single nucleotide mismatch which does not include the 3 nucleotide NGG sequence is GATGCTGAGTACAGCCACCT (SEQ ID NO: 5326), with the italicized G being the mismatched nucleotide. Those skilled in the art will appreciate, however, that the single nucleotide mismatch can comprise any nucleotide in the ribonucleic acid, e.g., the first nucleotide, the second nucleotide, the third nucleotide, the fourth nucleotide, the fifth nucleotide, the sixth nucleotide, the seventh nucleotide, the eighth nucleotide, the ninth nucleotide, the tenth nucleotide, the eleventh nucleotide, the twelfth nucleotide, the thirteenth nucleotide, the fourteenth nucleotide, the fifteenth nucleotide, the sixteenth nucleotide, the seventeenth nucleotide, the eighteenth nucleotide, the nineteenth nucleotide, or the twentieth nucleotide of the ribonucleic acid.

In some embodiments, the different sequences of the multiple ribonucleic acids described above comprise at least 12 nucleotide fragments of a ribonucleic acid sequence of any of FIGS. 1-15. In some embodiments, the different sequences of the multiple ribonucleic acids described above comprise at least 12 nucleotide fragments sequences with single nucleotide mismatches to a sequence selected from the group consisting of a ribonucleic acid sequence of any of FIGS. 1-15. For example, if a target sequence is GATGCTCAGTACAGCCACCTTGG (SEQ ID NO: 5323), a different sequence of the multiple ribonucleic acids comprising at least a 12 nucleotide fragment with single nucleotide mismatch comprises GTACAGCCACCT (SEQ ID NO: 5327).

In some embodiments, the different sequences of the multiple ribonucleic acids described above comprise at least 13 nucleotide fragments of a ribonucleic acid sequence of any of FIGS. 1-15. In some embodiments, the different sequences of the multiple ribonucleic acids described above comprise at least 13 nucleotide fragments sequences with single nucleotide mismatches to a sequence selected from the group consisting of a ribonucleic acid sequence of any of FIGS. 1-15. For example, if a target sequence is GATGCTCAGTACAGCCACCTTGG (SEQ ID NO: 5323), a different sequence of the multiple ribonucleic acids comprising at least a 13 nucleotide fragment with single nucleotide mismatch comprises AGTACAGCCACCT (SEQ ID NO: 5328).

In some embodiments, the different sequences of the multiple ribonucleic acids described above comprise at least 14 nucleotide fragments of a ribonucleic acid sequence of any of FIGS. 1-15. In some embodiments, the different sequences of the multiple ribonucleic acids described above comprise at least 14 nucleotide fragments sequences with single nucleotide mismatches to a sequence selected from the group consisting of a ribonucleic acid sequence of any of FIGS. 1-15. For example, if a target sequence is GATGCTCAGTACAGCCACCTTGG (SEQ ID NO: 5323), a different sequence of the multiple ribonucleic acids comprising at least a 14 nucleotide fragment with single nucleotide mismatch comprises CAGTACAGCCACCT (SEQ ID NO: 5329).

In some embodiments, the different sequences of the multiple ribonucleic acids described above comprise at least 15 nucleotide fragments of a ribonucleic acid sequence of any of FIGS. 1-15. In some embodiments, the different sequences of the multiple ribonucleic acids described above comprise at least 15 nucleotide fragments sequences with single nucleotide mismatches to a sequence selected from the group consisting of a ribonucleic acid sequence of any of FIGS. 1-15. For example, if a target sequence is GATGCTCAGTACAGCCACCTTGG (SEQ ID NO: 5323), a different sequence of the multiple ribonucleic acids comprising at least a 15 nucleotide fragment with single nucleotide mismatch comprises TCAGTACAGCCACCT (SEQ ID NO: 5330).

In some embodiments, the different sequences of the multiple ribonucleic acids described above comprise at least 16 nucleotide fragments of a ribonucleic acid sequence of any of FIGS. 1-15. In some embodiments, the different sequences of the multiple ribonucleic acids described above comprise at least 16 nucleotide fragments sequences with single nucleotide mismatches to a sequence selected from the group consisting of a ribonucleic acid sequence of any of FIGS. 1-15. For example, if a target sequence is GATGCTCAGTACAGCCACCTTGG (SEQ ID NO: 5323), a different sequence of the multiple ribonucleic acids comprising at least a 16 nucleotide fragment with single nucleotide mismatch comprises CTCAGTACAGCCACCT (SEQ ID NO: 5331).

In some embodiments, the different sequences of the multiple ribonucleic acids described above comprise at least 17 nucleotide fragments of a ribonucleic acid sequence of any of FIGS. 1-15. In some embodiments, the different sequences of the multiple ribonucleic acids described above comprise at least 17 nucleotide fragments sequences with single nucleotide mismatches to a sequence selected from the group consisting of a ribonucleic acid sequence of any of FIGS. 1-15. For example, if a target sequence is GATGCTCAGTACAGCCACCTTGG (SEQ ID NO: 5323), a different sequence of the multiple ribonucleic acids comprising at least a 17 nucleotide fragment with single nucleotide mismatch comprises GCTCAGTACAGCCACCT (SEQ ID NO: 5332).

In some embodiments, the different sequences of the multiple ribonucleic acids described above comprise at least 18 nucleotide fragments of a ribonucleic acid sequence of any of FIGS. 1-15. In some embodiments, the different sequences of the multiple ribonucleic acids described above comprise at least 18 nucleotide fragments sequences with single nucleotide mismatches to a sequence selected from the group consisting of a ribonucleic acid sequence of any of FIGS. 1-15. For example, if a target sequence is GATGCTCAGTACAGCCACCTTGG (SEQ ID NO: 5323), a different sequence of the multiple ribonucleic acids comprising at least a 18 nucleotide fragment with single nucleotide mismatch comprises TGCTCAGTACAGCCACCT (SEQ ID NO: 5333).

In some embodiments, the different sequences of the multiple ribonucleic acids described above comprise at least 19 nucleotide fragments of a ribonucleic acid sequence of any of FIGS. 1-15. In some embodiments, the different sequences of the multiple ribonucleic acids described above comprise at least 19 nucleotide fragments sequences with single nucleotide mismatches to a sequence selected from the group consisting of a ribonucleic acid sequence of any of FIGS. 1-15. For example, if a target sequence is GATGCTCAGTACAGCCACCTTGG (SEQ ID NO: 5323), a different sequence of the multiple ribonucleic acids comprising at least a 19 nucleotide fragment with single nucleotide mismatch comprises ATGCTCAGTACAGCCACCT (SEQ ID NO: 5334).

In some embodiments, the different sequences of the multiple ribonucleic acids described above comprise at least 20 nucleotide fragments of a ribonucleic acid sequence of any of FIGS. 1-15. In some embodiments, the different sequences of the multiple ribonucleic acids described above comprise at least 20 nucleotide fragments sequences with single nucleotide mismatches to a sequence selected from the group consisting of a ribonucleic acid sequence of any of FIGS. 1-15. For example, if a target sequence is GATGCTCAGTACAGCCACCTTGG (SEQ ID NO: 5323), a different sequence of the multiple ribonucleic acids comprising at least a 12 nucleotide fragment with single nucleotide mismatch comprises GATGCTCAGTACAGCCACCT (SEQ ID NO: 5324).

It should be appreciated that any of the Cas protein or the ribonucleic acids can be expressed from a plasmid. In some embodiments, any of the Cas protein or the ribonucleic acids are expressed using a promoter optimized for increased expression in stem cells (e.g., human stem cells). In some embodiments, the promoter is selected from the group consisting of a Cytomegalovirus (CMV) early enhancer element and a chicken beta-actin promoter, a chicken beta-actin promoter, an elongation factor-1 alpha promoter, and a ubiquitin promoter.

In some embodiments, the methods of the present invention further comprise selecting cells that express the Cas protein. The present invention contemplates any suitable method for selecting cells. In some embodiments, selecting cells comprises FACS. In some embodiments, FACs is used to select cells which co-express Cas and a fluorescent protein selected from the group consisting of green fluorescent protein and red fluorescent protein.

The present invention contemplates treating and/or preventing a variety of disorders which are associated with expression of a target polynucleotide sequences. It should be appreciated that the methods and compositions described herein can be used to treat or prevent disorders associated with increased expression of a target polynucleotide sequence, as well as decreased expression of a target polynucleotide sequence in a cell. Increased and decreased expression of a target polynucleotide sequence includes circumstances where the expression levels of the target polynucleotide sequence are increased or decreased, respectively, as well as circumstances in which the function and/or level of activity of an expression product of the target polynucleotide sequence increases or decreases, respectively, compared to normal expression and/or activity levels. Those skilled in the art will appreciate that treating or preventing a disorder associated with increased expression of a target polynucleotide sequence can be assessed by determining whether the levels and/or activity of the target polynucleotide sequence (or an expression product thereof) are decreased in a relevant cell after employing a method or administering a composition described herein. The skilled artisan will also appreciate that treating or preventing a disorder associated with decreased expression of a target polynucleotide sequence can be assessed by determining whether the levels and/or activity of the target polynucleotide sequence (or an expression product thereof) are increased in the relevant cell after employing a method or administering a composition described herein.

In some embodiments, the disorder is a genetic disorder. In some embodiments, the disorder is a monogenic disorder. In some embodiments, the disorder is a multigenic disorder. In some embodiments, the disorder is a disorder associated with one or more SNPs. Exemplary disorders associated with one or more SNPs include a complex disease described in U.S. Pat. No. 7,627,436, Alzheimer's disease as described in PCT International Application Publication No. WO/2009/112882, inflammatory diseases as described in U.S. Patent Application Publication No. 2011/0039918, polycystic ovary syndrome as described in U.S. Patent Application Publication No. 2012/0309642, cardiovascular disease as described in U.S. Pat. No. 7,732,139, Huntington's disease as described in U.S. Patent Application Publication No. 2012/0136039, thromboembolic disease as described in European Patent Application Publication No. EP2535424, neurovascular diseases as described in PCT International Application Publication No. WO/2012/001613, psychosis as described in U.S. Patent Application Publication No. 2010/0292211, multiple sclerosis as described in U.S. Patent Application Publication No. 2011/0319288, schizopherenia, schizoaffective disorder, and bipolar disorder as described in PCT International Application Publication No. WO/2006/023719A2, bipolar disorder and other ailments as described in U.S. Patent Application Publication No. U.S. 2011/0104674, colorectal cancer as described in PCT International Application Publication No. WO/2006/104370A1, a disorder associated with a SNP adjacent to the AKT1 gene locus as described in U.S. Patent Application Publication No. U.S. 2006/0204969, an eating disorder as described in PCT International Application Publication No. WO/2003/012143A1, autoimmune disease as described in U.S. Patent Application Publication No. U.S. 2007/0269827, fibrostenosing disease in patients with Chrohn's disease as described in U.S. Pat. No. 7,790,370, and Parkinson's disease as described in U.S. Pat. No. 8,187,811, each of which is incorporated herein by reference in its entirety. Other disorders associated with one or more SNPs which can be treated or prevented according to the methods of the present invention will be apparent to the skilled artisan.

In some embodiments, the disorder is severe combined immunodeficiency. In some embodiments, the disorder is X-linked moderate combined immunodeficiency. In some embodiments, the disorder is X-linked severe combined immunodeficiency. In some embodiments, the disorder is adenosine deaminase deficiency or SCID associated with adenosine deaminase deficiency. In some embodiments, the disorder is Athabascan type SCID. In some embodiments, the disorder is T cell-negative, B-cell/natural killer cell-positive SCID. In some embodiments, the disorder is T-negative/B-positive type autosomal recessive SCID. In some embodiments, the disorder is SCID with sensitivity to ionizing radiation. In some embodiments, the disorder is SCID with microcephaly, growth retardation, and sensitivity to ionizing radiation. In some embodiments, the disorder is reticular dysgenesis. In some embodiments, the disorder is LIG4 syndrome. In some embodiments, the disorder is alpha/beta T-cell lymphopenia with gamma/delta T-cell expansion, severe cytomegalovirus infection, and autoimmunity. In some embodiments, the disorder is combined cellular and humoral immune defects with granulomas. In some embodiments, the disorder is B cell-negative SCID. In some embodiments, the disorder is a selective T-cell defect or selective T-cell defect associated with SCID. In some embodiments, the disorder is purine nucleoside phosphorylase deficiency or SCID associated with purine nucleoside phosphorylase deficiency. In some embodiments, the disorder is Omenn syndrome. In some embodiments, the disorder is bare lymphocyte syndrome. In some embodiments, the disorder is SCID associated with JAK3 mutation. In some embodiments, the disorder is SCID associated with DCLRE1C mutation. In some embodiments, the disorder is a disorder listed in any one of the Gene Phenotype Relationship tables listed herein. In some embodiments, the disorder is sickle cell anemia. In some embodiments, the disorder is sickle cell disease. In some embodiments, the disorder is sickle cell anemia. In some embodiments, the disorder is sickle beta thalassemia. In some embodiments, the disorder is beta thalassemia.

The methods of the present invention are capable of altering target polynucleotide sequences in a variety of different cells. In some embodiments, the methods of the present invention are used to alter target polynucleotide sequences in cells ex vivo for subsequent introduction into a subject. In some embodiments, the methods of the present invention can be used to alter target polynucleotide sequences in cells in vivo. In some embodiments, the cell is a peripheral blood cell. In some embodiments, the cell is a stem cell or a pluripotent cell. In some embodiments, the cell is a hematopoietic stem cell. In some embodiments, the cell is a CD34+ cell. In some embodiments, the cell is a CD34+ mobilized peripheral blood cell. In some embodiments, the cell is a CD34+ cord blood cell. In some embodiments, the cell is a CD34+ bone marrow cell. In some embodiments, the cell is a CD34+CD38-Lineage-CD90+CD45RA− cell. In some embodiments, the cell is a hepatocyte. In some embodiments, the cell is a human pluripotent cell. In some embodiments, the cell is a primary human cell. In some embodiments, the cell is a non-transformed cell. In some embodiments, the cell is not a cancer cell. In some embodiments, the cell is not a tumor cell. In some embodiments, the cell is not a transformed cell.

In some aspects, the present invention provides a method for altering a target SCID-associated polynucleotide sequence in a cell comprising contacting the SCID-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target SCID-associated polynucleotide sequence, wherein the target SCID-associated polynucleotide sequence is cleaved, and wherein the efficiency of alteration of cells that express Cas protein is from about 8% to about 80%.

In some aspects, the present invention provides a method for altering a target SCD-associated polynucleotide sequence in a cell comprising contacting the SCD-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target SCD-associated polynucleotide sequence, wherein the target SCD-associated polynucleotide sequence is cleaved, and wherein the efficiency of alteration of cells that express Cas protein is from about 8% to about 80%.

In some aspects, the present invention provides a method for altering a target beta thalassemia-associated polynucleotide sequence in a cell comprising contacting the beta thalassemia-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target beta thalassemia-associated polynucleotide sequence, wherein the target beta thalassemia-associated polynucleotide sequence is cleaved, and wherein the efficiency of alteration of cells that express Cas protein is from about 8% to about 80%.

In some aspects, the present invention provides a method for treating or preventing a disorder associated with expression of a SCID-associated polynucleotide sequence in a subject, the method comprising (a) altering a target SCID-associated polynucleotide sequence in a cell ex vivo by contacting the SCID-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target SCID-associated polynucleotide sequence, wherein the target SCID-associated polynucleotide sequence is cleaved, and wherein the efficiency of alteration is from about 8% to about 80%, and (b) introducing the cell into the subject, thereby treating or preventing a disorder associated with expression of the SCID-associated polynucleotide sequence.

In some embodiments, the method includes the step of contacting, before the step of introducing the cell into the subject, the cleaved SCID-associated polynucleotide sequences with an exogenously introduced DNA repair template comprising a corresponding normal or wild-type polynucleotide sequence, thereby allowing homology-directed repair to replace the cleaved SCID-associated polynucleotide sequence with the corresponding normal or wild type polynucleotide sequence. In embodiments in which the target SCID-associated polynucleotide sequences comprise ADA polynucleotide sequences, the exogenously introduced DNA repair template comprises a corresponding wild-type or normal ADA polynucleotide sequence.

In embodiments in which the target SCID-associated polynucleotide sequences comprise AK2 polynucleotide sequences, the exogenously introduced DNA repair template comprises a corresponding wild-type or normal AK2 polynucleotide sequence.

In embodiments in which the target SCID-associated polynucleotide sequences comprise CD3D polynucleotide sequences, the exogenously introduced DNA repair template comprises a corresponding wild-type or normal CD3D polynucleotide sequence.

In embodiments in which the target SCID-associated-polynucleotide sequences comprise DCLRE1C polynucleotide sequences, the exogenously introduced DNA repair template comprises a corresponding wild-type or normal DCLRE1C polynucleotide sequence.

In embodiments in which the target SCID-associated polynucleotide sequences comprise IL2RG polynucleotide sequences, the exogenously introduced DNA repair template comprises a corresponding wild-type or normal IL2RG polynucleotide sequence.

In embodiments in which the target SCID-associated polynucleotide sequences comprise IL7R polynucleotide sequences, the exogenously introduced DNA repair template comprises a corresponding wild-type or normal IL7R polynucleotide sequence.

In embodiments in which the target SCID-associated polynucleotide sequences comprise JAK3 polynucleotide sequences, the exogenously introduced DNA repair template comprises a corresponding wild-type or normal JAK3 polynucleotide sequence.

In embodiments in which the target SCID-associated polynucleotide sequences comprise LIG4 polynucleotide sequences, the exogenously introduced DNA repair template comprises a corresponding wild-type or normal LIG4 polynucleotide sequence.

In embodiments in which the target SCID-associated polynucleotide sequences comprise NHEJ1 polynucleotide sequences, the exogenously introduced DNA repair template comprises a corresponding wild-type or normal NHEJ1 polynucleotide sequence.

In embodiments in which the target SCID-associated polynucleotide sequences comprise PNP polynucleotide sequences, the exogenously introduced DNA repair template comprises a corresponding wild-type or normal PNP polynucleotide sequence.

In embodiments in which the target SCID-associated polynucleotide sequences comprise PRKDC polynucleotide sequences, the exogenously introduced DNA repair template comprises a corresponding wild-type or normal PRKDC polynucleotide sequence.

In embodiments in which the target SCID-associated polynucleotide sequences comprise RAG1 polynucleotide sequences, the exogenously introduced DNA repair template comprises a corresponding wild-type or normal RAG1 polynucleotide sequence.

In embodiments in which the target SCID-associated polynucleotide sequences comprise RAG2 polynucleotide sequences, the exogenously introduced DNA repair template comprises a corresponding wild-type or normal RAG2 polynucleotide sequence.

In embodiments in which the target SCID-associated polynucleotide sequences comprise ZAP70 polynucleotide sequences, the exogenously introduced DNA repair template comprises a corresponding wild-type or normal ZAP70 polynucleotide sequence.

In some aspects, the present invention provides a method for treating or preventing a disorder associated with expression of a SCD-associated polynucleotide sequence in a subject, the method comprising (a) altering a target SCD-associated polynucleotide sequence in a cell ex vivo by contacting the SCD-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target SCD-associated polynucleotide sequence, wherein the target SCD-associated polynucleotide sequence is cleaved, and wherein the efficiency of alteration is from about 8% to about 80%, and (b) introducing the cell into the subject, thereby treating or preventing a disorder associated with expression of the SCD-associated polynucleotide sequence.

In some embodiments, the method includes the step of contacting, before the step of introducing the cell into the subject, the cleaved SCD-associated polynucleotide sequences with an exogenously introduced DNA repair template comprising a normal HBB sequence, thereby allowing homology-directed repair to replace the cleaved SCD-associated polynucleotide sequence with the normal HBB sequence.

In some aspects, the present invention provides a method for treating or preventing a disorder associated with expression of a beta thalassemia-associated polynucleotide sequence in a subject, the method comprising (a) altering a target beta thalassemia-associated polynucleotide sequence in a cell ex vivo by contacting the beta thalassemia-associated polynucleotide sequence in a cell selected from the group consisting of a human pluripotent cell, a primary human cell, and a non-transformed human cell, with a clustered regularly interspaced short palindromic repeats-associated (Cas) protein and from one to two ribonucleic acids, wherein the ribonucleic acids direct Cas protein to and hybridize to a target motif of the target beta thalassemia-associated polynucleotide sequence, wherein the target beta thalassemia-associated polynucleotide sequence is cleaved, and wherein the efficiency of alteration is from about 8% to about 80%, and (b) introducing the cell into the subject, thereby treating or preventing a disorder associated with expression of the beta thalassemia-associated polynucleotide sequence.

In some embodiments, the method includes the step of contacting, before the step of introducing the cell into the subject, the cleaved beta thalassemia-associated polynucleotide sequences with an exogenously introduced DNA repair template comprising a normal HBB sequence, thereby allowing homology-directed repair to replace the cleaved beta thalassemia-associated polynucleotide sequence with the normal HBB sequence.

In some aspects, the present invention provides a method for simultaneously altering multiple target SCID-associated polynucleotide sequences in a cell comprising contacting the SCID-associated polynucleotide sequences in a cell selected from the group consisting of a human pluripotent cell, a primary human cell, and a non-transformed human cell, with a clustered regularly interspaced short palindromic repeats-associated (Cas) protein and multiple ribonucleic acids, wherein the ribonucleic acids direct Cas protein to and hybridize to target motifs of the target SCID-associated polynucleotide sequences, wherein the target SCD-associated polynucleotide sequences are cleaved, and wherein the efficiency of alteration of cells that express Cas protein is from about 8% to about 80%.

In some embodiments, the method includes the step of contacting the cleaved target SCID-associated polynucleotide sequences with an exogenously introduced DNA repair template comprising a corresponding normal or wild-type sequence (e.g., of a ADA gene, a AK2 gene, a CD3D gene, a DCLRE1C gene, a IL2RG gene, IL7R gene, a LIG4 gene, a NHEJ1 gene, a PNP gene, a PRKDC gene, a RAG1 gene, a RAG2 gene, a ZAP70 gene), thereby allowing homology-directed repair to replace the mutant portion of the cleaved SCID-associated polynucleotide sequence with the corresponding normal or wild-type sequence (e.g., of the ADA gene, the AK2 gene, the CD3D gene, the DCLRE1C gene, the IL2RG gene, the IL7R gene, the LIG4 gene, the NHEJ1 gene, the PNP gene, the PRKDC gene, the RAG1 gene, the RAG2 gene, the ZAP70 gene).

In some aspects, the present invention provides a method for simultaneously altering multiple target SCD-associated polynucleotide sequences in a cell comprising contacting the SCD-associated polynucleotide sequences in a cell selected from the group consisting of a human pluripotent cell, a primary human cell, and a non-transformed human cell, with a clustered regularly interspaced short palindromic repeats-associated (Cas) protein and multiple ribonucleic acids, wherein the ribonucleic acids direct Cas protein to and hybridize to target motifs of the target SCD-associated polynucleotide sequences, wherein the target SCD-associated polynucleotide sequences are cleaved, and wherein the efficiency of alteration of cells that express Cas protein is from about 8% to about 80%.

In some embodiments, the method includes the step of contacting the cleaved target SCD-associated polynucleotide sequences with an exogenously introduced DNA repair template comprising a normal HBB sequence, thereby allowing homology-directed repair to replace the mutant portion of the cleaved SCD-associated polynucleotide sequence with the normal HBB sequence.

In some aspects, the present invention provides a method for simultaneously altering multiple target beta thalassemia-associated polynucleotide sequences in a cell comprising contacting the beta thalassemia-associated polynucleotide sequences in a cell selected from the group consisting of a human pluripotent cell, a primary human cell, and a non-transformed human cell, with a clustered regularly interspaced short palindromic repeats-associated (Cas) protein and multiple ribonucleic acids, wherein the ribonucleic acids direct Cas protein to and hybridize to target motifs of the target beta thalassemia-associated polynucleotide sequences, wherein the target beta thalassemia-associated polynucleotide sequences are cleaved, and wherein the efficiency of alteration of cells that express Cas protein is from about 8% to about 80%.

In some embodiments, the method includes the step of contacting the cleaved target beta thalassemia-associated polynucleotide sequences with an exogenously introduced DNA repair template comprising a normal HBB sequence, thereby allowing homology-directed repair to replace the mutant portion of the cleaved beta thalassemia-associated polynucleotide sequence with the normal HBB sequence.

In some aspects, the present invention provides a method for treating or preventing a disorder associated with expression of SCID-associated polynucleotide sequences in a subject, the method comprising (a) altering target SCID-associated polynucleotide sequences in a cell ex vivo by contacting the SCD-associated polynucleotide sequences in a cell selected from the group consisting of a human pluripotent cell, a primary human cell, and a non-transformed human cell, with a clustered regularly interspaced short palindromic repeats-associated (Cas) protein and) multiple ribonucleic acids, wherein the ribonucleic acids direct Cas protein to and hybridize to target motifs of the target SCID-associated polynucleotide sequences, wherein the target SCID-associated polynucleotide sequences are cleaved, and wherein the efficiency of alteration of cells that express Cas protein is from about 8% to about 80%, and (b) introducing the cell into the subject, thereby treating or preventing a disorder associated with expression of the SCID-associated polynucleotide sequences.

In some embodiments, the method includes the step of contacting, before the step of introducing the cell into the subject, the cleaved SCID-associated polynucleotide sequences with an exogenously introduced DNA repair template comprising a corresponding normal or wild-type sequence (e.g., of a ADA gene, a AK2 gene, a CD3D gene, a DCLRE1C gene, a IL2RG gene, a IL7R gene, a LIG4 gene, a NHEJ1 gene, a PNP gene, a PRKDC gene, a RAG1 gene, a RAG2 gene, a ZAP70 gene), thereby allowing homology-directed repair to replace the cleaved SCD-associated polynucleotide sequence with the normal or wild-type sequence (e.g., of the ADA gene, the AK2 gene, the CD3D gene, the DCLRE1C gene, the IL2RG gene, the IL7R gene, the LIG4 gene, the NHEJ1 gene, the PNP gene, the PRKDC gene, the RAG1 gene, the RAG2 gene, the ZAP70 gene).

In some aspects, the present invention provides a method for treating or preventing a disorder associated with expression of SCD-associated polynucleotide sequences in a subject, the method comprising (a) altering target SCD-associated polynucleotide sequences in a cell ex vivo by contacting the SCD-associated polynucleotide sequences in a cell selected from the group consisting of a human pluripotent cell, a primary human cell, and a non-transformed human cell, with a clustered regularly interspaced short palindromic repeats-associated (Cas) protein and multiple ribonucleic acids, wherein the ribonucleic acids direct Cas protein to and hybridize to target motifs of the target SCD-associated polynucleotide sequences, wherein, the target SCD-associated polynucleotide sequences are cleaved, and wherein the efficiency of alteration of cells that express Cas protein is from about 8% to about 80%, and (b) introducing the cell into the subject, thereby treating or preventing a disorder associated with expression of the SCD-associated polynucleotide sequences.

In some embodiments, the method includes the step of contacting, before the step of introducing the cell into the subject, the cleaved SCD-associated polynucleotide sequences with an exogenously introduced DNA repair template comprising a normal HBB sequence, thereby allowing homology-directed repair to replace the cleaved SCD-associated polynucleotide sequence with the normal HBB sequence.

In some aspects, the present invention provides a method for treating or preventing a disorder associated with expression of beta thalassemia-associated polynucleotide sequences in a subject, the method comprising (a) altering target beta thalassemia-associated polynucleotide sequences in a cell ex vivo by contacting the beta thalassemia-associated polynucleotide sequences in a cell selected from the group consisting of a human pluripotent cell, a primary human cell, and a non-transformed human cell, with a clustered regularly interspaced short palindromic repeats-associated (Cas) protein and multiple ribonucleic acids, wherein the ribonucleic acids direct Cas protein to and hybridize to target motifs of the target beta thalassemia-associated polynucleotide sequences, wherein the target beta thalassemia-associated polynucleotide sequences are cleaved, and wherein the efficiency of alteration of cells that express Cas protein is from about 8% to about 80%, and (b) introducing the cell into the subject, thereby treating or preventing a disorder associated with expression of the beta thalassemia-associated polynucleotide sequences.

In some embodiments, the method includes the step of contacting, before the step of introducing the cell into the subject, the cleaved beta thalassemia-associated polynucleotide sequences with an exogenously introduced DNA repair template comprising a normal HBB sequence, thereby allowing homology-directed repair to replace the cleaved beta thalassemia-associated polynucleotide sequence with the normal HBB sequence.

The present invention also provides compositions comprising Cas proteins of the present invention or functional portions thereof, nucleic acids encoding the Cas proteins or functional portions thereof and ribonucleic acid sequences which direct Cas proteins to and hybridize to target motifs of target polynucleotides in a cell.

For administration to a subject, a composition as disclosed herein can be administered to a subject, for example in pharmaceutically acceptable compositions. Pharmaceutically acceptable compositions comprise a therapeutically-effective amount of a Cas protein of the present invention or functional portion thereof, nucleic acids encoding the Cas proteins (e.g., modified, synthetic mRNA), and ribonucleic acid sequences which direct Cas proteins to and hybridize, formulated together with one or more pharmaceutically acceptable carriers (additives) and/or diluents.

As described in detail below, the pharmaceutical compositions of the present invention can be specially formulated for administration in solid or liquid form, including those adapted for the following: (1) oral administration, for example, drenches (aqueous or non-aqueous solutions or suspensions), lozenges, dragees, capsules, pills, tablets (e.g., those targeted for buccal, sublingual, and systemic absorption), boluses, powders, granules, pastes for application to the tongue; (2) parenteral administration, for example, by subcutaneous, intramuscular, intravenous or epidural injection as, for example, a sterile solution or suspension, or sustained-release formulation; (3) topical application, for example, as a cream, ointment, or a controlled-release patch or spray applied to the skin; (4) intravaginally or intrarectally, for example, as a pessary, cream or foam; (5) sublingually; (6) ocularly; (7) transdermally; (8) transmucosally; or (9) nasally. Additionally, compounds can be implanted into a patient or injected using a drug delivery system. See, for example, Urquhart, et al., Ann. Rev. Pharmacol. Toxicol. 24: 199-236 (1984); Lewis, ed. "Controlled Release of Pesticides and Pharmaceuticals" (Plenum Press, New York, 1981); U.S. Pat. Nos. 3,773,919; and 35 3,270,960.

As used here, the term "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

The phrase "therapeutically-effective amount" as used herein in respect to a Cas protein and/or ribonucleic acids described herein means that amount of relevant protein and/or ribonucleic acid, or composition comprising the same which is effective for producing some desired therapeutic effect in at least a sub-population of cells in an animal at a reasonable benefit/risk ratio applicable to any medical treatment. For example, an amount administered to a subject that is sufficient to produce a statistically significant, measurable change in at least one symptom of sickle cell anemia (e.g., reduced red blood cell count.). Determination of a therapeutically effective amount is well within the capability of those skilled in the art. Generally, a therapeutically effective amount can vary with the subject's history, age, condition, sex, as well as the severity and type of the medical condition in the subject, and administration of other pharmaceutically active agents.

As used herein, the term "administer" refers to the placement of a composition into a subject by a method or route which results in at least partial localization of the composition at a desired site such that desired effect is produced. A compound or composition described herein can be administered by any appropriate route known in the art including, but not limited to, oral or parenteral routes, including intravenous, intramuscular, subcutaneous, transdermal, airway (aerosol), pulmonary, nasal, rectal, and topical (including buccal and sublingual) administration.

Exemplary modes of administration include, but are not limited to, injection, infusion, instillation, inhalation, or ingestion. "Injection" includes, without limitation, intravenous, intramuscular, intraarterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. In preferred embodiments, the compositions are administered by intravenous infusion or injection.

In some aspects, the present invention provides a composition comprising at least one ribonucleic acid having a sequence selected from the group consisting of the ribonucleic acid sequences of FIG. 1.

In some aspects, the present invention provides a composition comprising at least one ribonucleic acid comprising a sequence with a single nucleotide mismatch to a sequence selected from the group consisting of the ribonucleic acid sequences of FIG. 1.

In some aspects, the present invention provides a composition comprising at least one ribonucleic acid having a sequence selected from the group consisting of the ribonucleic acid sequences of FIG. 2.

In some aspects, the present invention provides a composition comprising at least one ribonucleic acid comprising a sequence with a single nucleotide mismatch to a sequence selected from the group consisting of the ribonucleic acid sequences of FIG. 2.

In some aspects, the present invention provides a composition comprising at least one ribonucleic acid having a sequence selected from the group consisting of the ribonucleic acid sequences of FIG. 3. In some aspects, the present invention provides a composition comprising at least one ribonucleic acid comprising a sequence with a single nucleotide mismatch to a sequence selected from the group consisting of the ribonucleic acid sequences of FIG. 3.

In some aspects, the present invention provides a composition comprising at least one ribonucleic acid having a sequence selected from the group consisting of the ribonucleic acid sequences of FIG. 4. In some aspects, the present invention provides a composition comprising at least one ribonucleic acid comprising a sequence with a single nucleotide mismatch to a sequence selected from the group consisting of the ribonucleic acid sequences of FIG. 4.

In some aspects, the present invention provides a composition comprising at least one ribonucleic acid having a sequence selected from the group consisting of the ribonucleic acid sequences of FIG. 5. In some aspects, the present invention provides a composition comprising at least one ribonucleic acid comprising a sequence with a single nucleotide mismatch to a sequence selected from the group consisting of the ribonucleic acid sequences of FIG. 5.

In some aspects, the present invention provides a composition comprising at least one ribonucleic acid having a sequence selected from the group consisting of the ribonucleic acid sequences of FIG. 6. In some aspects, the present invention provides a composition comprising at least one ribonucleic acid comprising a sequence with a single nucleotide mismatch to a sequence selected from the group consisting of the ribonucleic acid sequences of FIG. 6.

In some aspects, the present invention provides a composition comprising at least one ribonucleic acid having a sequence selected from the group consisting of the ribonucleic acid sequences of FIG. 7. In some aspects, the present invention provides a composition comprising at least one ribonucleic acid comprising a sequence with a single nucleotide mismatch to a sequence selected from the group consisting of the ribonucleic acid sequences of FIG. 7.

In some aspects, the present invention provides a composition comprising at least one ribonucleic acid having a sequence selected from the group consisting of the ribonucleic acid sequences of FIG. 8. In some aspects, the present invention provides a composition comprising at least one ribonucleic acid comprising a sequence with a single nucleotide mismatch to a sequence selected from the group consisting of the ribonucleic acid sequences of FIG. 8.

In some aspects, the present invention provides a composition comprising at least one ribonucleic acid having a sequence selected from the group consisting of the ribonucleic acid sequences of FIG. 9. In some aspects, the present invention provides a composition comprising at least one ribonucleic acid comprising a sequence with a single nucleotide mismatch to a sequence selected from the group consisting of the ribonucleic acid sequences of FIG. 9.

In some aspects, the present invention provides a composition comprising at least one ribonucleic acid having a sequence selected from the group consisting of the ribonucleic acid sequences of FIG. 10. In some aspects, the present invention provides a composition comprising at least one ribonucleic acid comprising a sequence with a single nucleotide mismatch to a sequence selected from the group consisting of the ribonucleic acid sequences of FIG. 10.

In some aspects, the present invention provides a composition comprising at least one ribonucleic acid having a sequence selected from the group consisting of the ribonucleic acid sequences of FIG. 11. In some aspects, the present invention provides a composition comprising at least one ribonucleic acid comprising a sequence with a single nucleotide mismatch to a sequence selected from the group consisting of the ribonucleic acid sequences of FIG. 11.

In some aspects, the present invention provides a composition comprising at least one ribonucleic acid having a sequence selected from the group consisting of the ribonucleic acid sequences of FIG. 12. In some aspects, the present invention provides a composition comprising at least one ribonucleic acid comprising a sequence with a single nucleotide mismatch to a sequence selected from the group consisting of the ribonucleic acid sequences of FIG. 12.

In some aspects, the present invention provides a composition comprising at least one ribonucleic acid having a sequence selected from the group consisting of the ribonucleic acid sequences of FIG. 13. In some aspects, the present invention provides a composition comprising at least one ribonucleic acid comprising a sequence with a single nucleotide mismatch to a sequence selected from the group consisting of the ribonucleic acid sequences of FIG. 13.

In some aspects, the present invention provides a composition comprising at least one ribonucleic acid having a sequence selected from the group consisting of the ribonucleic acid sequences of FIG. 14. In some aspects, the present invention provides a composition comprising at least one ribonucleic acid comprising a sequence with a single nucleotide mismatch to a sequence selected from the group consisting of the ribonucleic acid sequences of FIG. 14.

In some aspects, the present invention provides a composition comprising at least one ribonucleic acid having a sequence selected from the group consisting of the ribonucleic acid sequences of FIG. 15. In some aspects, the present invention provides a composition comprising at least one ribonucleic acid comprising a sequence with a single nucleotide mismatch to a sequence selected from the group consisting of the ribonucleic acid sequences of FIG. 15.

In some aspects, the present invention provides a composition comprising at least one ribonucleic acid having a ribonucleic acid sequences of GTAACGGCAGACTTCTC-CACAGG (SEQ ID NO: 5321). In some aspects, the present invention provides a composition comprising at least one ribonucleic acid comprising a sequence with a single nucleotide mismatch to ribonucleic acid sequences of GTAACG-GCAGACTTCTCCACAGG (SEQ ID NO: 5321). In some embodiments, the at least one ribonucleic acid sequences described above do not include the 3 nucleotide NGG sequence.

For example, if the target site sequence is GATGCTCA-GTACAGCCACCTTGG (SEQ ID NO: 5323), the ribonucleic acid sequence of the at least one ribonucleic acid sequence is GATGCTCAGTACAGCCACCT (SEQ ID NO: 5324). As another example, if the target sequence is GAT-GCTCAGTACAGCCACCTTGG (SEQ ID NO: 5323), a ribonucleic acid sequence with a single nucleotide mismatch which does not include the 3 nucleotide NGG sequence is GATGCTGAGTACAGCCACCT (SEQ ID NO: 5326), with the italicized G being the mismatched nucleotide. Those skilled in the art will appreciate, however, that the single nucleotide mismatch can comprise any nucleotide in the ribonucleic acid, e.g., the first nucleotide, the second nucleotide, the third nucleotide, the fourth nucleotide, the fifth nucleotide, the sixth nucleotide, the seventh nucleotide, the eighth nucleotide, the ninth nucleotide, the tenth nucleotide, the eleventh nucleotide, the twelfth nucleotide, the thirteenth nucleotide, the fourteenth nucleotide, the fifteenth nucleotide, the sixteenth nucleotide, the seventeenth nucleotide, the eighteenth nucleotide, the nineteenth nucleotide, or the twentieth nucleotide of the ribonucleic acid.

In some embodiments, the at least one ribonucleic acid described above comprises at least a 12 nucleotide fragment of a ribonucleic acid sequence of any of FIGS. 1-15. In some embodiments, the at least one ribonucleic acid described above comprises at least a 12 nucleotide fragment of a sequence with a single nucleotide mismatch to a sequence selected from the group consisting of a ribonucleic acid sequence of any of FIGS. 1-15. In some embodiments, the at least one ribonucleic acid described above comprises at least a 12 nucleotide fragment of a ribonucleic acid sequence of GTAACGGCAGACTTCTCCACAGG (SEQ ID NO: 5321). In some embodiments, the at least one ribonucleic acid described above comprises at least a 12 nucleotide fragment of a sequence with a single nucleotide mismatch to a ribonucleic acid sequence of any of GTAACGGCAGACT-TCTCCACAGG (SEQ ID NO: 5321). For example, if the target sequence is GATGCTCAGTACAGCCACCTTGG (SEQ ID NO: 5323), the ribonucleic acid sequence of the at least one ribonucleic acid which comprises at least a 12 nucleotide fragment is GTACAGCCACCT (SEQ ID NO: 5327).

In some embodiments, the ribonucleic acid sequence of the at least one ribonucleic acid described above comprises at least a 13 nucleotide fragment of a ribonucleic acid sequence of any of FIGS. 1-15. In some embodiments, the ribonucleic acid sequence of the at least one ribonucleic acid described above comprises at least a 13 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 13 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 13 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 13 nucleotide fragment is AGTACAGCCACCT (SEQ ID NO: 5328).

In some embodiments, the ribonucleic acid sequence of the at least one ribonucleic acid described above comprises at least a 14 nucleotide fragment of a ribonucleic acid sequence of any of FIGS. 1-15. In some embodiments, the ribonucleic acid sequence of the at least one ribonucleic acid described above comprises at least a 14 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 14 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 14 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 14 nucleotide fragment is CAGTACAGCCACCT (SEQ ID NO: 5329).

In some embodiments, the ribonucleic acid sequence of the at least one ribonucleic acid described above comprises at least a 15 nucleotide fragment of a ribonucleic acid sequence of any of FIGS. 1-15. In some embodiments, the ribonucleic acid sequence of the at least one ribonucleic acid described above comprises at least a 15 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 15 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 15 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 15 nucleotide fragment is TCAGTACAGCCACCT (SEQ ID NO: 5330).

In some embodiments, the ribonucleic acid sequence of the at least one ribonucleic acid described above comprise at least a 16 nucleotide fragment of a ribonucleic acid sequence of any of FIGS. 1-15. In some embodiments, the ribonucleic acid sequence of the at least one ribonucleic acid described above comprises at least a 16 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprise at least a 16 nucleotide fragment of a ribonucleic acid sequence of GTAACGGCAGACT-TCTCCACAGG (SEQ ID NO: 5321). In some embodiments, the ribonucleic acid sequence of the at least one ribonucleic acid described above comprises at least a 16 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 16 nucleotide fragment is CTCAGTACAGCCACCT (SEQ ID NO: 5331).

In some embodiments, the ribonucleic acid sequence of the at least one ribonucleic acid described above comprises at least a 17 nucleotide fragment of a ribonucleic acid sequence of any of FIGS. 1-15. In some embodiments, the ribonucleic acid sequence of the at least one ribonucleic acid described above comprises at least a 17 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 17 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 17 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 17 nucleotide fragment is GCTCAGTACAGCCACCT (SEQ ID NO: 5332).

In some embodiments, the ribonucleic acid sequence of the at least one ribonucleic acid described above comprises at least a 18 nucleotide fragment of a ribonucleic acid sequence of any of FIGS. 1-15. In some embodiments, the ribonucleic acid sequence of the at least one ribonucleic acid described above comprises at least a 18 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 18 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 18 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 18 nucleotide fragment is TGCTCAGTACAGCCACCT (SEQ ID NO: 5333).

In some embodiments, the ribonucleic acid sequence of the at least one ribonucleic acid described above comprise at least a 19 nucleotide fragment of a ribonucleic acid sequence of any of FIGS. 1-15. In some embodiments, the ribonucleic acid sequence of the at least one ribonucleic acid described above comprises at least a 19 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprise at least a 19 nucleotide fragment of a ribonucleic acid sequence of GTAACGGCAGACT-TCTCCACAGG (SEQ ID NO: 5321). In some embodiments, the ribonucleic acid sequence of the at least one ribonucleic acid described above comprises at least a 19 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 19 nucleotide fragment is ATGCTCAGTACAGCCACCT (SEQ ID NO: 5334).

In some embodiments, the ribonucleic acid sequence of the at least one ribonucleic acid described above comprises at least a 20 nucleotide fragment of a ribonucleic acid sequence of any of FIGS. 1-15. In some embodiments, the ribonucleic acid sequence of the at least one ribonucleic acid described above comprises at least a 20 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 20 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 20 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 20 nucleotide fragment is GATGCTCAGTACAGCCACCT (SEQ ID NO: 5324).

In some embodiments, the at least one ribonucleic acid in the composition is contained in a nanoparticle. In some embodiments, the at least one ribonucleic acid is contained in a lipid nanoparticle. In some embodiments, the lipid nanoparticle comprises at least one of a cationic lipid, a neutral lipid, an amino lipid, a sterol, and a PEG or PEG-modified lipid.

In some embodiments, at least one of the ribonucleic acids in the composition is a modified ribonucleic acid as described herein (e.g., a synthetic, modified ribonucleic acid, e.g., comprising one to two modified nucleotides selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate, or any other modified nucleotides or modifications described herein).

In some embodiments, a composition of the present invention comprises a nucleic acid sequence encoding a Cas protein. In some embodiments, a composition of the present invention comprises nucleic acid sequence encoding Cas9 protein or a functional portion thereof.

In some embodiments, the nucleic acid encoding the Cas protein (e.g., Cas9) comprises a modified ribonucleic acid as described herein (e.g., a synthetic, modified mRNA described herein, e.g., comprising at least one modified nucleotide selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate or any other modified nucleotides or modifications described herein).

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 1.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 2.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 3.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 4.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 5.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 6.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 7.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 8.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 9.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 10.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 11.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 12.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 13.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 14.

In some aspects, the present invention provides a composition comprising a chimeric nucleic acid comprising a ribonucleic acid encoding a Cas protein and at least one additional ribonucleic acid having a sequence selected from the group consisting of the ribonucleic acid sequences of FIG. 15.

In some aspects, the present invention provides a composition comprising a chimeric nucleic acid comprising a ribonucleic acid encoding a Cas protein and at least one additional ribonucleic acid having a ribonucleic acid sequence of GTAACGGCAGACTTCTCCACAGG (SEQ ID NO: 5321).

In some embodiments, the at least one additional ribonucleic acid sequences described above do not include the 3 nucleotide NGG sequence.

For example, if the target site sequence is GATGCTCAGTACAGCCACCTTGG (SEQ ID NO: 5323), the ribonucleic acid sequence of the at least one additional ribonucleic acid is GATGCTCAGTACAGCCACCT (SEQ ID NO: 5324). As another example, if the target sequence is GATGCTCAGTACAGCCACCTTGG (SEQ ID NO: 5323), a ribonucleic acid sequence with a single nucleotide mismatch which does not include the 3 nucleotide NGG sequence is GATGCTGAGTACAGCCACCT (SEQ ID NO: 5326), with the italicized G being the mismatched nucleotide. Those skilled in the art will appreciate, however, that the single nucleotide mismatch can comprise any nucleotide in the ribonucleic acid, e.g., the first nucleotide, the second nucleotide, the third nucleotide, the fourth nucleotide, the fifth nucleotide, the sixth nucleotide, the seventh nucleotide, the eighth nucleotide, the ninth nucleotide, the tenth nucleotide, the eleventh nucleotide, the twelfth nucleotide, the thirteenth nucleotide, the fourteenth nucleotide, the fifteenth nucleotide, the sixteenth nucleotide, the seventeenth nucleotide, the eighteenth nucleotide, the nineteenth nucleotide, or the twentieth nucleotide of the ribonucleic acid.

In some embodiments, the at least one additional ribonucleic acid described above comprises at least a 12 nucleotide fragment of a ribonucleic acid sequence of any of FIGS. 1-15. In some embodiments, the at least one additional ribonucleic acid described above comprises at least a 12 nucleotide fragment of a sequence with a single nucleotide mismatch to a sequence selected from the group consisting of a ribonucleic acid sequence of any of FIGS. 1-15. In some embodiments, the at least one additional ribonucleic acid described above comprises at least a 12 nucleotide fragment of a ribonucleic acid sequence of any of GTAACGGCAGACTTCTCCACAGG (SEQ ID NO: 5321). In some embodiments, the at least one additional ribonucleic acid described above comprises at least a 12 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 12 nucleotide fragment is GTACAGCCACCT (SEQ ID NO: 5327).

In some embodiments, the ribonucleic acid sequence of the at least one additional ribonucleic acid described above comprises at least a 13 nucleotide fragment of a ribonucleic acid sequence of any of FIGS. 1-15. In some embodiments, the ribonucleic acid sequence of the at least one additional ribonucleic acid described above comprises at least a 13 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprises at least a 13 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 13 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 13 nucleotide fragment is AGTACAGCCACCT (SEQ ID NO: 5328).

In some embodiments, the ribonucleic acid sequence of the at least one additional ribonucleic acid described above comprises at least a 14 nucleotide fragment of a ribonucleic acid sequence of any of FIGS. 1-15. In some embodiments, the ribonucleic acid sequence of the at least one additional ribonucleic acid described above comprises at least a 14 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprises at least a 14 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 14 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 14 nucleotide fragment is CAGTACAGCCACCT (SEQ ID NO: 5329).

In some embodiments, the ribonucleic acid sequence of the at least one additional ribonucleic acid described above comprises at least a 15 nucleotide fragment of a ribonucleic acid sequence of any of FIGS. 1-15. In some embodiments, the ribonucleic acid sequence of the at least one additional ribonucleic acid described above comprises at least a 15 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprises at least a 15 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 15 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 15 nucleotide fragment is TCAGTACAGCCACCT (SEQ ID NO: 5330).

In some embodiments, the ribonucleic acid sequence of the at least one additional ribonucleic acid described above comprise at least a 16 nucleotide fragment of a ribonucleic acid sequence of any of FIGS. 1-15. In some embodiments, the ribonucleic acid sequence of the at least one additional ribonucleic acid described above comprises at least a 16 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprise at least a 16 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 16 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 16 nucleotide fragment is CTCAGTACAGCCACCT (SEQ ID NO: 5331).

In some embodiments, the ribonucleic acid sequence of the at least one ribonucleic acid described above comprises at least a 17 nucleotide fragment of a ribonucleic acid sequence of any of FIGS. 1-15. In some embodiments, the ribonucleic acid sequence of the at least one additional ribonucleic acid described above comprises at least a 17 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 17 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 17 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 17 nucleotide fragment is GCTCAGTACAGCCACCT (SEQ ID NO: 5332).

In some embodiments, the ribonucleic acid sequence of the at least one additional ribonucleic acid described above comprises at least a 18 nucleotide fragment of a ribonucleic acid sequence of any of FIGS. 1-15. In some embodiments, the ribonucleic acid sequence of the at least one additional ribonucleic acid described above comprises at least a 18 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprises at least a 18 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 18nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 18nucleotide fragment is TGCTCAGTACAGCCACCT (SEQ ID NO: 5333).

In some embodiments, the ribonucleic acid sequence of the at least one additional ribonucleic acid described above comprise at least a 19 nucleotide fragment of a ribonucleic acid sequence of any of FIGS. 1-15. In some embodiments, the ribonucleic acid sequence of the at least one additional ribonucleic acid described above comprises at least a 19 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprise at least a 19 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 19 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 19 nucleotide fragment is ATGCTCAGTACAGCCACCT (SEQ ID NO: 5334).

In some embodiments, the ribonucleic acid sequence of the at least one additional ribonucleic acid described above comprises at least a 20 nucleotide fragment of a ribonucleic acid sequence of any of FIGS. 1-15. In some embodiments, the ribonucleic acid sequence of the at least one additional ribonucleic acid described above comprises at least a 20 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprises at least a 20 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 20 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 20 nucleotide fragment is GATGCTCAGTACAGCCACCT (SEQ ID NO: 5324).

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 1.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 2.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 3.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 4.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 5.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 6.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 7.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 8.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 9.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 10.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 11.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 12.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 13.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 14.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a sequence selected from the group consisting of the ribonucleic acid sequences of FIG. 15.

In some aspects, the present invention provides a composition comprising a chimeric nucleic acid comprising a ribonucleic acid encoding a Cas protein and at least one additional ribonucleic acid sequence comprising a sequence with a single nucleotide mismatch to a ribonucleic acid sequence of GTAACGGCAGACTTCTCCACAGG (SEQ ID NO: 5321).

In some embodiments, the at least one additional ribonucleic acid sequences described above do not include the 3 nucleotide NGG sequence. For example, if the target site sequence is GATGCTCAGTACAGCCACCTTGG (SEQ ID NO: 5323), the ribonucleic acid sequence of the at least one additional ribonucleic acid is GATGCTCAGTACAGCCACCT (SEQ ID NO: 5324). As another example, if the target sequence is GATGCTCAGTACAGCCACCTTGG (SEQ ID NO: 5323), a ribonucleic acid sequence with a single nucleotide mismatch which does not include the 3 nucleotide NGG sequence is GATGCTGAGTACAGCCACCT (SEQ ID NO: 5326), with the italicized G being the mismatched nucleotide. Those skilled in the art will appreciate, however, that the single nucleotide mismatch can comprise any nucleotide in the ribonucleic acid, e.g., the first nucleotide, the second nucleotide, the third nucleotide, the fourth nucleotide, the fifth nucleotide, the sixth nucleotide, the seventh nucleotide, the eighth nucleotide, the ninth nucleotide, the tenth nucleotide, the eleventh nucleotide, the twelfth nucleotide, the thirteenth nucleotide, the fourteenth nucleotide, the fifteenth nucleotide, the sixteenth nucleotide, the seventeenth nucleotide, the eighteenth nucleotide, the nineteenth nucleotide, or the twentieth nucleotide of the ribonucleic acid.

In some embodiments, the at least one additional ribonucleic acid described above comprises at least a 12 nucleotide fragment of a ribonucleic acid sequence of any of FIGS. 1-15. In some embodiments, the at least one additional ribonucleic acid described above comprises at least a 12 nucleotide fragment of a sequence with a single nucleotide mismatch to a sequence selected from the group consisting of a ribonucleic acid sequence of any of FIGS. 1-15. In some embodiments, the at least one additional ribonucleic acid described above comprises at least a 12 nucleotide fragment of a ribonucleic acid sequence of GTAACGGCAGACTTCTCCACAGG (SEQ ID NO: 5321). In some embodiments, the at least one additional ribonucleic acid described above comprises at least a 12 nucleotide fragment of a sequence with a single nucleotide mismatch to a sequence selected from the group consisting of a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 12 nucleotide fragment is GTACAGCCACCT (SEQ ID NO: 5327).

In some embodiments, the ribonucleic acid sequence of the at least one additional ribonucleic acid described above comprises at least a 13 nucleotide fragment of a ribonucleic acid sequence of any of FIGS. 1-15. In some embodiments, the ribonucleic acid sequence of the at least one additional ribonucleic acid described above comprises at least a 13 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprises at least a 13 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 13 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 13 nucleotide fragment is AGTACAGCCACCT (SEQ ID NO: 5328).

In some embodiments, the ribonucleic acid sequence of the at least one additional ribonucleic acid described above comprises at least a 14 nucleotide fragment of a ribonucleic acid sequence of any of FIGS. 1-15. In some embodiments, the ribonucleic acid sequence of the at least one additional ribonucleic acid described above comprises at least a 14 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprises at least a 14 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 14 nucleotide fragment of a sequence with a single nucleotide mismatch to a ribonucleic acid sequence of GTAACGGCAGACTTCTC-CACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 14 nucleotide fragment is CAGTACAGCCACCT (SEQ ID NO: 5329).

In some embodiments, the ribonucleic acid sequence of the at least one additional ribonucleic acid described above comprises at least a 15 nucleotide fragment of a ribonucleic acid sequence of any of FIGS. 1-15. In some embodiments, the ribonucleic acid sequence of the at least one additional ribonucleic acid described above comprises at least a 15 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprises at least a 15 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 15 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 15 nucleotide fragment is TCAGTACAGCCACCT (SEQ ID NO: 5330).

In some embodiments, the ribonucleic acid sequence of the at least one additional ribonucleic acid described above comprise at least a 16 nucleotide fragment of a ribonucleic acid sequence of any of FIGS. 1-15. In some embodiments, the ribonucleic acid sequence of the at least one additional ribonucleic acid described above comprises at least a 16 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprise at least a 16 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 16 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 16 nucleotide fragment is CTCAGTACAGCCACCT (SEQ ID NO: 5331).

In some embodiments, the ribonucleic acid sequence of the at least one ribonucleic acid described above comprises at least a 17 nucleotide fragment of a ribonucleic acid sequence of any of FIGS. 1-15. In some embodiments, the ribonucleic acid sequence of the at least one additional ribonucleic acid described above comprises at least a 17 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 17 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 17 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 17 nucleotide fragment is GCTCAGTACAGCCACCT (SEQ ID NO: 5332).

In some embodiments, the ribonucleic acid sequence of the at least one additional ribonucleic acid described above comprises at least a 18 nucleotide fragment of a ribonucleic acid sequence of any of FIGS. 1-15. In some embodiments, the ribonucleic acid sequence of the at least one additional ribonucleic acid described above comprises at least a 18 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprises at least a 18 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 18 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 18 nucleotide fragment is TGCTCAGTACAGCCACCT (SEQ ID NO: 5333).

In some embodiments, the ribonucleic acid sequence of the at least one additional ribonucleic acid described above comprise at least a 19 nucleotide fragment of a ribonucleic acid sequence of any of FIGS. 1-15. In some embodiments, the ribonucleic acid sequence of the at least one additional ribonucleic acid described above comprises at least a 19 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprise at least a 19 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 19 nucleotide fragment of a sequence with a single nucleotide mismatch to a ribonucleic acid sequence of GTAACGGCAGACTTCTC-CACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 19 nucleotide fragment is ATGCTCAGTACAGCCACCT (SEQ ID NO: 5334).

In some embodiments, the ribonucleic acid sequence of the at least one additional ribonucleic acid described above comprises at least a 20 nucleotide fragment of a ribonucleic acid sequence of any of FIGS. 1-15. In some embodiments, the ribonucleic acid sequence of the at least one additional ribonucleic acid described above comprises at least a 20 nucleotide fragment of a sequence with a single nucleotide mismatch to a sequence selected from the group consisting of a ribonucleic acid sequence of any of FIGS. 1-15. In some embodiments, the ribonucleic acid sequence of the at least one additional ribonucleic acid described above comprises at least a 20 nucleotide fragment of a ribonucleic acid sequence of GTAACGGCAGACTTCTCCACAGG (SEQ ID NO: 5321). In some embodiments, the ribonucleic acid sequence of the at least one additional ribonucleic acid described above comprises at least a 20 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one additional ribonucleic acid which comprises at least a 20 nucleotide fragment is GATGCTCAGTACAGCCACCT (SEQ ID NO: 5324).

In some embodiments, a composition of the present invention comprises a nucleic acid sequence encoding a fluorescent protein selected from the group consisting of green fluorescent protein and red fluorescent protein. In some embodiments, a composition of the present invention comprises a promoter operably linked to the chimeric nucleic acid. In some embodiments, the promoter is optimized for increased expression in human stem cells. In some embodiments, the promoter is selected from the group consisting of a Cytomegalovirus (CMV) early enhancer element and a chicken beta-actin promoter, a chicken beta-actin promoter, an elongation factor-1 alpha promoter, and a ubiquitin promoter.

In some embodiments, the chimeric nucleic acid is contained in a nanoparticle. In some embodiments, the chimeric nucleic acid is contained in a lipid nanoparticle as described herein. In some embodiments, the chimeric nucleic acid comprises at least one modified nucleotide described herein. In some embodiments, the Cas protein comprises a Cas9 protein or a functional portion thereof.

For in vivo methods, a therapeutically effective amount of a composition described herein can be administered to a subject. Methods of administering compositions to a subject are known in the art and easily available to one of skill in the art.

In some embodiments, a composition described herein includes one or more additional pharmaceutically active agents for treating or preventing the disorder associated with expression of the target polynucleotide sequence.

The present invention also provides kits for practicing any of the methods of the present invention, as well as kits comprising the compositions of the present invention, and instructions for using the kits for altering target polynucleotide sequences in a cell.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 1.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 2.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 3.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 4.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 5.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 6.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 7.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 8.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 9.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 10.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 11.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 12.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 13.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 14.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of the ribonucleic acid sequences of FIG. 15.

In some aspects, the present invention comprises a kit for altering a target polynucleotide sequence in a cell comprising a Cas9 protein or a nucleic acid encoding the Cas9 protein, and at least one ribonucleic acid sequence having a ribonucleic acid sequence of GTAACGGCAGACTTCTCCACAGG (SEQ ID NO: 5321).

In some embodiments, the at least one ribonucleic acid sequences described above do not include the 3 nucleotide NGG sequence. For example, if the target site sequence is GATGCTCAGTACAGCCACCTTGG (SEQ ID NO: 5323), the ribonucleic acid sequence of the at least one ribonucleic acid sequence is GATGCTCAGTACAGCCACCT (SEQ ID NO: 5324). As another example, if the target sequence is GATGCTCAGTACAGCCACCTTGG (SEQ ID NO: 5323), a ribonucleic acid sequence with a single nucleotide mismatch which does not include the 3 nucleotide NGG sequence is GATGCTGAGTACAGCCACCT (SEQ ID NO: 5326), with the italicized G being the mismatched nucleotide. Those skilled in the art will appreciate, however, that the single nucleotide mismatch can comprise any nucleotide in the ribonucleic acid, e.g., the first nucleotide, the second nucleotide, the third nucleotide, the fourth nucleotide, the fifth nucleotide, the sixth nucleotide, the seventh nucleotide, the eighth nucleotide, the ninth nucleotide, the tenth nucleotide, the eleventh nucleotide, the twelfth nucleotide, the thirteenth nucleotide, the fourteenth nucleotide, the fifteenth nucleotide, the sixteenth nucleotide, the seventeenth nucleotide, the eighteenth nucleotide, the nineteenth nucleotide, or the twentieth nucleotide of the ribonucleic acid.

In some embodiments, the at least one ribonucleic acid described above comprises at least a 12 nucleotide fragment of a ribonucleic acid sequence of any of FIGS. 1-15. In some embodiments, the at least one ribonucleic acid described above comprises at least a 12 nucleotide fragment of a sequence with a single nucleotide mismatch to a sequence selected from the group consisting of a ribonucleic acid sequence of any of FIGS. 1-15. In some embodiments, the at least one ribonucleic acid described above comprises at least a 12 nucleotide fragment of a ribonucleic acid sequence of GTAACGGCAGACTTCTCCACAGG (SEQ ID NO: 5321). In some embodiments, the at least one ribonucleic acid described above comprises at least a 12 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one ribonucleic acid which comprises at least a 12 nucleotide fragment is GTACAGCCACCT (SEQ ID NO: 5327).

In some embodiments, the ribonucleic acid sequence of the at least one ribonucleic acid described above comprises at least a 13 nucleotide fragment of a ribonucleic acid sequence of any of FIGS. 1-15. In some embodiments, the ribonucleic acid sequence of the at least one ribonucleic acid described above comprises at least a 13 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 13nucleotide fragment of a ribonucleic acid sequence of GTAACGGCAGACTTCTCCACAGG (SEQ ID NO: 5321). In some embodiments, the ribonucleic acid sequence of the at least one ribonucleic acid described above comprises at least a 13 nucleotide fragment of a sequence with a single nucleotide mismatch to f a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one ribonucleic acid which comprises at least a 13 nucleotide fragment is AGTACAGCCACCT (SEQ ID NO: 5328).

In some embodiments, the ribonucleic acid sequence of the at least one ribonucleic acid described above comprises at least a 14 nucleotide fragment of a ribonucleic acid sequence of any of FIGS. 1-15 In some embodiments, the ribonucleic acid sequence of the at least one ribonucleic acid described above comprises at least a 14 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 14 nucleotide fragment of a ribonucleic acid sequence of GTAACGGCAGACTTCTCCACAGG (SEQ ID NO: 5321). In some embodiments, the ribonucleic acid sequence of the at least one ribonucleic acid described above comprises at least a 14 nucleotide fragment of a sequence with a single nucleotide mismatch to a ribonucleic acid sequence of GTAACGGCAGACTTCTCTCCACAGG (SEQ ID NO: 5321). For example, if the target sequence is GATGCTCAGTACAGCCACCTTGG (SEQ ID NO: 5323), the ribonucleic acid sequence of the at least one ribonucleic acid which comprises at least a 14 nucleotide fragment is CAGTACAGCCACCT (SEQ ID NO: 5329).

In some embodiments, the ribonucleic acid sequence of the at least one ribonucleic acid described above comprises at least a 15 nucleotide fragment of a ribonucleic acid sequence of any of FIGS. 1-15. In some embodiments, the ribonucleic acid sequence of the at least one ribonucleic acid described above comprises at least a 15 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 15 nucleotide fragment of a ribonucleic acid sequence of GTAACGGCAGACTTCTCCACAGG (SEQ ID NO: 5321). In some embodiments, the ribonucleic acid sequence of the at least one ribonucleic acid described above comprises at least a 15 nucleotide fragment of a sequence with a single nucleotide mismatch to a ribonucleic acid sequence of GTAACGGCAGACTTCTCCACAGG (SEQ ID NO: 5321). For example, if the target sequence is GATGCTCAGTACAGCCACCTTGG (SEQ ID NO: 5323), the ribonucleic acid sequence of the at least one ribonucleic acid which comprises at least a 15 nucleotide fragment is TCAGTACAGCCACCT (SEQ ID NO: 5330).

In some embodiments, the ribonucleic acid sequence of the at least one ribonucleic acid described above comprise at least a 16 nucleotide fragment of a ribonucleic acid sequence of any of FIGS. 1-15. In some embodiments, the ribonucleic acid sequence of the at least one ribonucleic acid described above comprises at least a 16 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprise at least a 16 nucleotide fragment of a ribonucleic acid sequence of GTAACGGCAGACT-TCTCCACAGG (SEQ ID NO: 5321). In some embodiments, the ribonucleic acid sequence of the at least one ribonucleic acid described above comprises at least a 16 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence Jr the at least one ribonucleic acid which comprises at least a 16 nucleotide fragment is CTCAGTACAGCCACCT (SEQ ID NO: 5331).

In some embodiments, the ribonucleic acid sequence of the at least one ribonucleic acid described above comprises at least a 17 nucleotide fragment of a ribonucleic acid sequence of any of FIGS. 1-15. In some embodiments, the ribonucleic acid sequence of the at least one ribonucleic acid described above comprises at least a 17 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 17 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 17 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 17 nucleotide fragment is GCTCAGTACAGCCACCT (SEQ ID NO: 5332).

In some embodiments, the ribonucleic acid sequence of the at least one ribonucleic acid described above comprises at least a 18 nucleotide fragment of a ribonucleic acid sequence of any of FIGS. 1-15. In some embodiments, the ribonucleic acid sequence of the at least one ribonucleic acid described above comprises at least a 18 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 18 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 18 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 18 nucleotide fragment is TGCTCAGTACAGCCACCT (SEQ ID NO: 5333).

In some embodiments, the ribonucleic acid sequence of the at least one ribonucleic acid described above comprise at least a 19 nucleotide fragment of a ribonucleic acid sequence of any of FIGS. 1-15. In some embodiments, the ribonucleic acid sequence of the at least one ribonucleic acid described above comprises at least a 19 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprise at least a 19 nucleotide fragment of a ribonucleic acid sequence of GTAACGGCAGACT-TCTCCACAGG (SEQ ID NO: 5321). In some embodiments, the ribonucleic acid sequence of the at least one ribonucleic acid described above comprises at least a 19 nucleotide fragment of a sequence with a single nucleotide mismatch to a ribonucleic acid sequence of GTAACGGCA-GACTTCTCCACAGG CSEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 19 nucleotide fragment is ATGCTCAGTACAGCCACCT (SEQ ID NO: 5334).

In some embodiments, the ribonucleic acid sequence of the at least one ribonucleic acid described above comprises at least a 20 nucleotide fragment of a ribonucleic acid sequence of any of FIGS. 1-15. In some embodiments, the ribonucleic acid sequence of the at least one ribonucleic acid described above comprises at least a 20 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 20 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 20 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 20 nucleotide fragment is GATGCTCAGTACAGCCACCT (SEQ ID NO: 5324).

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 1, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 2, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 3, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 4, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 5, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 6, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 7, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 8, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 9, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 10, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 11, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 12, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 13, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 14, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence selected from the group consisting of the ribonucleic acid sequences of FIG. 15, and any combination thereof.

In some aspects, the present invention comprises a kit for altering a target polynucleotide sequence in a cell comprising a Cas9 protein or a nucleic acid encoding the Cas9 protein, and at least one ribonucleic acid sequence with a single nucleotide mismatch to a ribonucleic acid sequence of GTAACGGCAGACTTCTCCACAGG (SEQ ID NO: 5321).

In some embodiments, the at least one ribonucleic acid sequences with the single nucleotide mismatches described above do not include the 3 nucleotide NGG sequence. For example, if the target site sequence is GATGCTCAGTACAGCCACCTTGG (SEQ ID NO: 5323), the ribonucleic acid sequence of the at least one ribonucleic acid sequence is GATGCTCAGTACAGCCACCT (SEQ ID NO: 5324). As another example, if the target sequence is GATGCTCAGTACAGCCACCTTGG (SEQ ID NO: 5323), a ribonucleic acid sequence with a single nucleotide mismatch which does not include the 3 nucleotide NGG sequence is GATGCTGAGTACAGCCACCT (SEQ ID NO: 5326), with the italicized G being the mismatched nucleotide. Those skilled in the art will appreciate, however, that the single nucleotide mismatch can comprise any nucleotide in the ribonucleic acid, e.g., the first nucleotide, the second nucleotide, the third nucleotide, the fourth nucleotide, the fifth nucleotide, the sixth nucleotide, the seventh nucleotide, the eighth nucleotide, the ninth nucleotide, the tenth nucleotide, the eleventh nucleotide, the twelfth nucleotide, the thirteenth nucleotide, the fourteenth nucleotide, the fifteenth nucleotide, the sixteenth nucleotide, the seventeenth nucleotide, the eighteenth nucleotide, the nineteenth nucleotide, or the twentieth nucleotide of the ribonucleic acid.

In some embodiments, the at least one ribonucleic acid described above comprises at least a 12 nucleotide fragment of a ribonucleic acid sequence of any of FIGS. 1-15. In some embodiments, the at least one ribonucleic acid described above comprises at least a 12 nucleotide fragment of a sequence with a single nucleotide mismatch to a sequence selected from the group consisting of a ribonucleic acid sequence of any of FIGS. 1-15. In some embodiments, the at least one ribonucleic acid described above comprises at least a 12 nucleotide fragment of a ribonucleic acid sequence of GTAACGGCAGACTTCTCCACAGG (SEQ ID NO: 5321). In some embodiments, the at least one ribonucleic acid described above comprises at least a 12 nucleotide fragment of a sequence with a single nucleotide mismatch to a ribonucleic acid sequence of GTAACGGCAGACTTCTC-CACAGG (SEQ ID NO: 5321). For example, if the target sequence is GATGCTCAGTACAGCCACCTTGG (SEQ ID NO: 5323), the ribonucleic acid sequence of the at least one ribonucleic acid which comprises at least a 12 nucleotide fragment is GTACAGCCACCT (SEQ ID NO: 5327).

In some embodiments, the ribonucleic acid sequence of the at least one ribonucleic acid described above comprises at least a 13 nucleotide fragment of a ribonucleic acid sequence of any of FIGS. 1-15. In some embodiments, the ribonucleic acid sequence of the at least one ribonucleic acid described above comprises at least a 13 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 13 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 13 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 13 nucleotide fragment is AGTACAGCCACCT (SEQ ID NO: 5328).

In some embodiments, the ribonucleic acid sequence of the at least one ribonucleic acid described above comprises at least a 14 nucleotide fragment of a ribonucleic acid sequence of any of FIGS. 1-15. In some embodiments, the ribonucleic acid sequence of the at least one ribonucleic acid described above comprises at least a 14 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 14 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 14 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 14 nucleotide fragment is CAGTACAGCCACCT (SEQ ID NO: 5329).

In some embodiments, the ribonucleic acid sequence of the at least one ribonucleic acid described above comprises at least a 15 nucleotide fragment of a ribonucleic acid sequence of any of FIGS. 1-15. In some embodiments, the ribonucleic acid sequence of the at least one ribonucleic acid described above comprises at least a 15 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 15 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 15 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 15 nucleotide fragment is TCAGTACAGCCACCT (SEQ ID NO: 5330).

In some embodiments, the ribonucleic acid sequence of the at least one ribonucleic acid described above comprise at least a 16 nucleotide fragment of a ribonucleic acid sequence of any of FIGS. 1-15. In some embodiments, the ribonucleic acid sequence of the at least one ribonucleic acid described above comprises at least a 16 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprise at least a 16 nucleotide fragment of a ribonucleic acid sequence of GTAACGGCAGACT-TCTCCACAGG (SEQ ID NO: 5321). In some embodiments, the ribonucleic acid sequence of the at least one ribonucleic acid described above comprises at least a 16 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 16 nucleotide fragment is CTCAGTACAGCCACCT (SEQ ID NO: 5331).

In some embodiments, the ribonucleic acid sequence of the at least one ribonucleic acid described above comprises at least a 17 nucleotide fragment of a ribonucleic acid sequence of any of FIGS. 1-15. In some embodiments, the ribonucleic acid sequence of the at least one ribonucleic acid described above comprises at least a 17 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 17 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 17 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 17 nucleotide fragment is GCTCAGTACAGCCACCT (SEQ ID NO: 5332).

In some embodiments, the ribonucleic acid sequence of the at least one ribonucleic acid described above comprises at least a 18 nucleotide fragment of a ribonucleic acid sequence of any of FIGS. 1-15. In some embodiments, the ribonucleic acid sequence of the at least one ribonucleic acid described above comprises at least a 18 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 18 nucleotide fragment of a ribonucleic acid sequence of GTAACGGCA- GACTTCTCCACAGG (SEQ ID NO: 5321). In some embodiments, the ribonucleic acid sequence of the at least one ribonucleic acid described above comprises at least a 18 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 18 nucleotide fragment is TGCTCAGTACAGCCACCT (SEQ ID NO: 5333).

In some embodiments, the ribonucleic acid sequence of the at least one ribonucleic acid described above comprise at least a 19 nucleotide fragment of a ribonucleic acid sequence of any of FIGS. 1-15. In some embodiments, the ribonucleic acid sequence of the at least one ribonucleic acid described above comprises at least a 19 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprise at least a 19 nucleotide fragment of a ribonucleic acid sequence of GTAACGGCAGACT-TCTCCACAGG (SEQ ID NO: 5321). In some embodiments, the ribonucleic acid sequence of the at least one ribonucleic acid described above comprises at least a 19 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 19 nucleotide fragment is ATGCTCAGTACAGCCACCT (SEQ ID NO: 5334).

In some embodiments, the ribonucleic acid sequence of the at least one ribonucleic acid described above comprises at least a 20 nucleotide fragment of a ribonucleic acid sequence of any of FIGS. 1-15. In some embodiments, the ribonucleic acid sequence of the at least one ribonucleic acid described above comprises at least a 20 nucleotide fragment of a sequence with a single nucleotide mismatch to a sequence selected from the group consisting of a ribonucleic acid sequence of any of FIGS. 1-15. In some embodiments, the ribonucleic acid sequence of the at least one ribonucleic acid described above comprises at least a 20 nucleotide fragment of a ribonucleic acid sequence of GTAACGGCA-GACTTCTCCACAGG (SEQ ID NO: 5321). In some embodiments, the ribonucleic acid sequence of the at least one ribonucleic acid described above comprises at least a 20 nucleotide fragment of a sequence with a single nucleotide mismatch to a ribonucleic acid sequence of GTAACGGCA-GACTTCTCCACAGG (SEQ ID NO: 5321). For example, if the target sequence is GATGCTCAGTACAGCCACCT-TGG (SEQ ID NO: 5323), the ribonucleic acid sequence of the at least one ribonucleic acid which comprises at least a 20 nucleotide fragment is GATGCTCAGTACAGCCACCT (SEQ ID NO: 5324).

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 1 and at least one ribonucleic acid sequence with a single nucleotide mismatch to a ribonucleic acid sequence of FIG. 1, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 2 and at least one ribonucleic acid sequence with a single nucleotide mismatch to a ribonucleic acid sequence of FIG. 2, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 3 and at least one ribonucleic acid sequence with a single nucleotide mismatch to a ribonucleic acid sequence of FIG. 3, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 4 and at least one ribonucleic acid sequence with a single nucleotide mismatch to a ribonucleic acid sequence of FIG. 4, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 5 and at least one ribonucleic acid sequence with a single nucleotide mismatch to a ribonucleic acid sequence of FIG. 5, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 6 and at least one ribonucleic acid sequence with a single nucleotide mismatch to a ribonucleic acid sequence of FIG. 6, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 7 and at least one ribonucleic acid sequence with a single nucleotide mismatch to a ribonucleic acid sequence of FIG. 7, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 8 and at least one ribonucleic acid sequence with a single nucleotide mismatch to a ribonucleic acid sequence of FIG. 8, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 9 and at least one ribonucleic acid sequence with a single nucleotide mismatch to a ribonucleic acid sequence of FIG. 9, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 10 and at least one ribonucleic acid sequence with a single nucleotide mismatch to a ribonucleic acid sequence of FIG. 10, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 11 and at least one ribonucleic acid sequence with a single nucleotide mismatch to a ribonucleic acid sequence of FIG. 11, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 12 and at least one ribonucleic acid sequence with a single nucleotide mismatch to a ribonucleic acid sequence of FIG. 12, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 13 and at least one ribonucleic acid sequence with a single nucleotide mismatch to a ribonucleic acid sequence of FIG. 13, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 14 and at least one ribonucleic acid sequence with a single nucleotide mismatch to a ribonucleic acid sequence of FIG. 14, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of FIG. 15 and at least one ribonucleic acid sequence with a single nucleotide mismatch to a ribonucleic acid sequence of FIG. 15, and combinations thereof.

In some aspects, the present invention comprises a kit for altering a target polynucleotide sequence in a cell comprising a Cas9 protein or a nucleic acid encoding the Cas9 protein, and at least one ribonucleic acid sequence selected from the group consisting of at least one ribonucleic acid sequence of GTAACGGCAGACTTCTCCACAGG (SEQ ID NO: 5321) and at least one ribonucleic acid sequence with a single nucleotide mismatch to a ribonucleic acid sequence of GTAACGGCAGACTTCTCCACAGG (SEQ ID NO: 5321).

In some embodiments, the at least one ribonucleic acid sequences described above do not include the 3 nucleotide NGG sequence. For example, if the target site sequence is GATGCTCAGTACAGCCACCTTGG (SEQ ID NO: 5323), the ribonucleic acid sequence of the at least one ribonucleic acid sequence is GATGCTCAGTACAGCCACCT (SEQ ID NO: 5324). As another example, if the target sequence is GATGCTCAGTACAGCCACCTTGG (SEQ ID NO: 5323), a ribonucleic acid sequence with a single nucleotide mismatch which does not include the 3 nucleotide NGG sequence is GATGCTGAGTACAGCCACCT (SEQ ID NO: 5326), with the italicized G being the mismatched nucleotide. Those skilled in the art will appreciate, however, that the single nucleotide mismatch can comprise any nucleotide in the ribonucleic acid, e.g., the first nucleotide, the second nucleotide, the third nucleotide, the fourth nucleotide, the fifth nucleotide, the sixth nucleotide, the seventh nucleotide, the eighth nucleotide, the ninth nucleotide, the tenth nucleotide, the eleventh nucleotide, the twelfth nucleotide, the thirteenth nucleotide, the fourteenth nucleotide, the fifteenth nucleotide, the sixteenth nucleotide, the seventeenth nucleotide, the eighteenth nucleotide, the nineteenth nucleotide, or the twentieth nucleotide of the ribonucleic acid.

In some embodiments, the at least one ribonucleic acid described above comprises at least a 12 nucleotide fragment of a ribonucleic acid sequence of any of FIGS. 1-15. In some embodiments, the at least one ribonucleic acid described above comprises at least a 12 nucleotide fragment of a sequence with a single nucleotide mismatch to a sequence selected from the group consisting of a ribonucleic acid sequence of any of FIGS. 1-15. For example, if the target sequence is GATGCTCAGTACAGCCACCTTGG (SEQ ID NO: 5323), the ribonucleic acid sequence of the at least one ribonucleic acid which comprises at least a 12 nucleotide fragment is GTACAGCCACCT (SEQ ID NO: 5327).

In some embodiments, the ribonucleic acid sequence of the at least one ribonucleic acid described above comprises at least a 13 nucleotide fragment of a ribonucleic acid sequence of any of FIGS. 1-15. In some embodiments, the ribonucleic acid sequence of the at least one ribonucleic acid described above comprises at least a 13 nucleotide fragment of a sequence with a single nucleotide mismatch to a sequence selected from the group consisting of a ribonucleic acid sequence of any of FIGS. 1-15. For example, if the target sequence is GATGCTCAGTACAGCCACCTTGG (SEQ ID NO: 5323), the ribonucleic acid sequence of the at least one ribonucleic acid which comprises at least a 13 nucleotide fragment is AGTACAGCCACCT (SEQ ID NO: 5328).

In some embodiments, the ribonucleic acid sequence of the at least one ribonucleic acid described above comprises at least a 14 nucleotide fragment of a ribonucleic acid sequence of any of FIGS. 1-15. In some embodiments, the ribonucleic acid sequence of the at least one ribonucleic acid described above comprises at least a 14 nucleotide fragment of a sequence with a single nucleotide mismatch to a sequence selected from the group consisting of a ribonucleic acid sequence of any of FIGS. 1-15. For example, if the target sequence is GATGCTCAGTACAGCCACCTTGG (SEQ ID NO: 5323), the ribonucleic acid sequence of the at least one ribonucleic acid which comprises at least a 14 nucleotide fragment is CAGTACAGCCACCT (SEQ ID NO: 5329).

In some embodiments, the ribonucleic acid sequence of the at least one ribonucleic acid described above comprises at least a 15 nucleotide fragment of a ribonucleic acid sequence of any of FIGS. 1-15. In some embodiments, the ribonucleic acid sequence of the at least one ribonucleic acid described above comprises at least a 15 nucleotide fragment of a sequence with a single nucleotide mismatch to a sequence selected from the group consisting of a ribonucleic acid sequence of any of FIGS. 1-15. For example, if the target sequence is GATGCTCAGTACAGCCACCTTGG (SEQ ID NO: 5323), the ribonucleic acid sequence of the at least one ribonucleic acid which comprises at least a 15 nucleotide ragment is TCAGTACAGCCACCT (SEQ ID NO: 5330).

In some embodiments, the ribonucleic acid sequence of the at least one ribonucleic acid described above comprise at least a 16 nucleotide fragment of a ribonucleic acid sequence of any of FIGS. 1-15. In some embodiments, the ribonucleic acid sequence of the at least one ribonucleic acid described above comprises at least a 16 nucleotide fragment of a sequence with a single nucleotide mismatch to a sequence selected from the group consisting of a ribonucleic acid sequence of any of FIGS. 1-15. For example, if the target sequence is GATGCTCAGTACAGCCACCTTGG (SEQ ID NO: 5323), the ribonucleic acid sequence of the at least one ribonucleic acid which comprises at least a 16 nucleotide fragment is CTCAGTACAGCCACCT (SEQ ID NO: 5331).

In some embodiments, the ribonucleic acid sequence of the at least one ribonucleic acid described above comprises at least a 17 nucleotide fragment of a ribonucleic acid sequence of any of FIGS. 1-15. In some embodiments, the ribonucleic acid sequence of the at least one ribonucleic acid described above comprises at least a 17 nucleotide fragment of a sequence with a single nucleotide mismatch to a sequence selected from the group consisting of a ribonucleic acid sequence of any of FIGS. 1-15. For example, if the target sequence is GATGCTCAGTACAGCCACCTTGG (SEQ ID NO: 5323), the ribonucleic acid sequence of the at least one ribonucleic acid which comprises at least a 17 nucleotide fragment is GCTCAGTACAGCCACCT (SEQ ID NO: 5332).

In some embodiments, the ribonucleic acid sequence of the at least one ribonucleic acid described above comprises at least a 18 nucleotide fragment of a ribonucleic acid sequence of any of FIGS. 1-15. In some embodiments, the ribonucleic acid sequence of the at least one ribonucleic acid described above comprises at least a 18 nucleotide fragment of a sequence with a single nucleotide mismatch to a sequence selected from the group consisting of a ribonucleic acid sequence of any of FIGS. 1-15. For example, if the target sequence is GATGCTCAGTACAGCCACCTTGG (SEQ ID NO: 5323), the ribonucleic acid sequence of the at least one ribonucleic acid which comprises at least a 18 nucleotide fragment is TGCTCAGTACAGCCACCT (SEQ ID NO: 5333).

In some embodiments, the ribonucleic acid sequence of the at least one ribonucleic acid described above comprise at least a 19 nucleotide fragment of a ribonucleic acid sequence of any of FIGS. 1-15. In some embodiments, the ribonucleic acid sequence of the at least one ribonucleic acid described above comprises at least a 19 nucleotide fragment of a sequence with a single nucleotide mismatch to a sequence selected from the group consisting of a ribonucleic acid sequence of any of FIGS. 1-15. For example, if the target sequence is GATGCTCAGTACAGCCACCTTGG (SEQ ID NO: 5323), the ribonucleic acid sequence of the at least one ribonucleic acid which comprises at least a 19 nucleotide fragment is ATGCTCAGTACAGCCACCT (SEQ ID NO: 5334).

In some embodiments, the ribonucleic acid sequence of the at least one ribonucleic acid described above comprises at least a 20 nucleotide fragment of a ribonucleic acid sequence of any of FIGS. 1-15. In some embodiments, the ribonucleic acid sequence of the at least one ribonucleic acid described above comprises at least a 20 nucleotide fragment of a sequence with a single nucleotide mismatch to a sequence selected from the group consisting of a ribonucleic acid sequence of any of FIGS. 1-15. For example, if the target sequence is GATGCTCAGTACAGCCACCTTGG (SEQ ID NO: 5323), the ribonucleic acid sequence of the at least one ribonucleic acid which comprises at least a 20 nucleotide fragment is GATGCTCAGTACAGCCACCT (SEQ ID NO: 5324).

In some embodiments, the at least one ribonucleic acid described above comprises at least a 12 nucleotide fragment, at least a 13 nucleotide fragment, at least a 14 nucleotide fragment, at least a 15 nucleotide fragment, at least a 16 nucleotide fragment, at least a 17 nucleotide fragment, at least an 18 nucleotide fragment, at least a 19 nucleotide fragment, or at least a 20 nucleotide sequence of a ribonucleic acid sequence of GTAACGGCAGACTTCTCCACAGG (SEQ ID NO: 5321). In some embodiments, the at least one ribonucleic acid described above comprises at least a 12, at least a 13, at least a 14, at least a 15, at least a 16, at least a 17, at least an 18, at least a 19, or at least a 20 nucleotide fragment of a sequence with a single nucleotide mismatch to a ribonucleic acid sequence of GTAACGGCAGACTTCTCCACAGG (SEQ ID NO: 5321).

In some embodiments, the kit comprises one or more cell lines, cultures, or populations selected from the group consisting of human pluripotent cells, primary human cells, and non-transformed cells. In some embodiments, the kit comprises a DNA repair template.

In some embodiments, the DNA repair template comprises one or more normal or wild-type ADA gene sequences. In some embodiments, the DNA repair template comprises one or more normal or wild-type DNA sequences that correspond to mutant ADA sequences to be cleaved from target SCID-associated polynucleotide sequences.

In some embodiments, the DNA repair template comprises one or more normal or wild-type AK2 gene sequences. In some embodiments, the DNA repair template comprises one or more normal or wild-type DNA sequences that correspond to mutant AK2 sequences to be cleaved from target SCID-associated polynucleotide sequences.

In some embodiments, the DNA repair template comprises one or more normal or wild-type CD3D gene sequences. In some embodiments, the DNA repair template comprises one or more normal or wild-type DNA sequences that correspond to mutant CD3D sequences to be cleaved from target SCID-associated polynucleotide sequences.

In some embodiments, the DNA repair template comprises one or more normal or wild-type DCLRE1C gene sequences. In some embodiments, the DNA repair template comprises one or more normal or wild-type DNA sequences that correspond to mutant DCLRE1C sequences to be cleaved from target SCID-associated polynucleotide sequences.

In some embodiments, the DNA repair template comprises one or more normal or wild-type IL2RG gene sequences. In some embodiments, the DNA repair template comprises one or more normal or wild-type DNA sequences that correspond to mutant IL2RG sequences to be cleaved from target SCID-associated polynucleotide sequences.

In some embodiments, the DNA repair template comprises one or more normal or wild-type IL7R gene sequences. In some embodiments, the DNA repair template comprises one or more normal or wild-type DNA sequences that correspond to mutant IL7R sequences to be cleaved from target SCID-associated polynucleotide sequences.

In some embodiments, the DNA repair template comprises one or more normal or wild-type JAK3 gene sequences. In some embodiments, the DNA repair template comprises one or more normal or wild-type DNA sequences that correspond to mutant JAK3 sequences to be cleaved from target SCID-associated polynucleotide sequences.

In some embodiments, the DNA repair template comprises one or more normal or wild-type NHEJ1 gene sequences. In some embodiments, the DNA repair template comprises one or more normal or wild-type DNA sequences that correspond to mutant NHEJ1 sequences to be cleaved from target SCID-associated polynucleotide sequences.

In some embodiments, the DNA repair template comprises one or more normal or wild-type PNP gene sequences. In some embodiments, the DNA repair template comprises one or more normal or wild-type DNA sequences that correspond to mutant PNP sequences to be cleaved from target SCID-associated polynucleotide sequences.

In some embodiments, the DNA repair template comprises one or more normal or wild-type PRKDC gene sequences. In some embodiments, the DNA repair template comprises one or more normal or wild-type DNA sequences that correspond to mutant PRKDC sequences to be cleaved from target SCID-associated polynucleotide sequences.

In some embodiments, the DNA repair template comprises one or more normal or wild-type RAG1 gene sequences. In some embodiments, the DNA repair template comprises one or more normal or wild-type DNA sequences that correspond to mutant RAG1 sequences to be cleaved from target SCID-associated polynucleotide sequences.

In some embodiments, the DNA repair template comprises one or more normal or wild-type RAG2 gene sequences. In some embodiments, the DNA repair template comprises one or more normal or wild-type DNA sequences that correspond to mutant RAG2 sequences to be cleaved from target SCID-associated polynucleotide sequences.

In some embodiments, the DNA repair template comprises one or more normal or wild-type ZAP70 gene sequences. In some embodiments, the DNA repair template comprises one or more normal or wild-type DNA sequences that correspond to mutant ZAP70 sequences to be cleaved from target SCID-associated polynucleotide sequences.

In some embodiments, the DNA repair template comprises one or more normal or wild-type HBB gene sequences. In some embodiments, the DNA repair template comprises one or more normal or wild-type DNA sequences that correspond to mutant HBB sequences to be cleaved from target SCD-associated polynucleotide sequences.

In some embodiments, the DNA repair template comprises one or more normal or wild-type DNA sequences that correspond to mutant HBB sequences to be cleaved from target beta thalassemia-associated polynucleotide sequences.

It should be appreciated that the methods, compositions, and kits of the present invention may employ nanoparticles or lipid nanoparticles as a vehicle for delivering, or introducing a Cas protein and/or a ribonucleic acid of the present invention into a cell.

In some embodiments, the lipid nanoparticle comprises at least one of a cationic lipid, a neutral lipid, an amino lipid, a sterol, and a PEG or PEG-modified lipid.

The cationic lipid may be, for example, N,N-dioleyl-N,N-dimethylammonium chloride (DODAC), N,N-distearyl-N,N-dimethylammonium bromide (DDAB), N-(1-(2,3-dioleoyloxy)propyl)-N,N,N-trimethylammonium chloride (DOTAP), N-(1-(2,3-dioleyloxyl)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAR.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLin-K-DMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl) tetrahydro-3 aH-cyclopenta[d][1,3]dioxol-5-amine (ALNY-100), (6Z,9Z,28Z,31Z)-heptatriaconta-6,9,28,31-tetraen-19-yl 4-(dimethylamino)butanoate (MC3), or a mixture thereof.

Other cationic lipids, which carry a net positive charge at about physiological pH, in addition to those specifically described above, may also be included in lipid particles of the invention. Such cationic lipids include, but are not limited to, N,N-dioleyl-N,N-dimethylammonium chloride ("DODAC"); N-(2,3-dioleyloxyl)propyl-N,N-N-triethylammonium chloride ("DOTMA"); N,N-distearyl-N,N-dimethylammonium bromide ("DDAB"); N-(2,3-dioleoyloxy)propyl)-N,N,N-trimethylammonium chloride ("DOTAP"); 1,2-Dioleyloxy-3-trimethylaminopropane chloride salt ("DOTAP.Cl"); 3.beta.-(N-(N',N'-dimethylaminoethane)-carbamoyl)cholesterol ("DC-Chol"), N-(1-(2,3-dioleyloxyl)propyl)-N-2-(sperminecarboxamido)ethyl)-N,N-dimethylammonium trifluoracetate ("DOSPA"), dioctadecylamidoglycyl carboxyspermine ("DOGS"), 1,2-dileoyl-sn-3-phosphoethanolamine ("DOPE"), 1,2-dioleoyl-3-dimethylammonium propane ("DOTAP"), N,N-dimethyl-2,3-dioleyloxy)propylamine ("DODMA"), and N-(1,2-dimyristyloxyprop-3-yl)-N,N-dimethyl-N-hydroxyethyl ammonium bromide ("DMRIE"), and mixtures thereof. Additionally, a number of commercial preparations of cationic lipids can be used, such as, e.g., LIPOFECTIN (including DOTMA and DOPE, available from GIBCO/BRL), and LIPOFECTAMINE (comprising DOSPA and DOPE, available from GIBCO/BRL). In particular embodiments, a cationic lipid is an amino lipid.

As used herein, the term "amino lipid" is meant to include those lipids having one or two fatty acid or fatty alkyl chains and an amino head group (including an alkylamino or dialkylamino group) that may be protonated to form a cationic lipid at physiological pH.

Other amino lipids would include those having alternative fatty acid groups and other dialkylamino groups, including those in which the alkyl substituents are different (e.g., N-ethyl-N-methylamino-, N-propyl-N-ethylamino- and the like). For those embodiments in which $R^{11}$ and $R^{12}$ are both long chain alkyl or acyl groups, they can be the same or different. In general, amino lipids having less saturated acyl chains are more easily sized, particularly when the complexes must be sized below about 0.3 microns, for purposes of filter sterilization. Amino lipids containing unsaturated fatty acids with carbon chain lengths in the range of $C_{14}$ to $C_{22}$ are preferred. Other scaffolds can also be used to separate the amino group and the fatty acid or fatty alkyl portion of the amino lipid. Suitable scaffolds are known to those of skill in the art.

Specific examples of PEG-modified lipids (or lipid-polyoxyethylene conjugates) that are useful in the present invention can have a variety of "anchoring" lipid portions to secure the PEG portion to the surface of the lipid vesicle. Examples of suitable PEG-modified lipids include PEG-modified phosphatidylethanolamine and phosphatidic acid, PEG-ceramide conjugates (e.g., PEG-CerC14 or PEG-CerC20) which are described in U.S. Pat. No. 5,820,873, incorporated herein by reference, PEG-modified dialkylamines and PEG-modified 1,2-diacyloxypropan-3-amines. Particularly preferred are PEG-modified diacylglycerols and dialkylglycerols.

Examples of suitable neutral lipid include DPSC, DPPC, POPC, DOPE, SM, and mixtures thereof.

As used herein "nucleic acid," in its broadest sense, includes any compound and/or substance that comprise a polymer of nucleotides linked via a phosphodiester bond. Exemplary nucleic acids include ribonucleic acids (RNAs), deoxyribonucleic acids (DNAs), threose nucleic acids (TNAs), glycol nucleic acids (GNAs), peptide nucleic acids (PNAs), locked nucleic acids (LNAs) or hybrids thereof. They may also include RNAi-inducing agents, RNAi agents, siRNAs, shRNAs, miRNAs, antisense RNAs, ribozymes, catalytic DNA, tRNA, RNAs that induce triple helix formation, aptamers, vectors, etc. In some embodiments, the nucleic acid encoding the Cas protein is an mRNA. In some embodiments, the Cas protein is encoded by a modified nucleic acid (e.g., a synthetic, modified mRNA described herein).

The present invention contemplates the use of any nucleic acid modification available to the skilled artisan. The nucleic acids of the present invention can include any number of modifications. In some embodiments, the nucleic acid comprises one or more modifications selected from the group consisting of pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl)adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, and combinations thereof.

Preparation of modified nucleosides and nucleotides used in the manufacture or synthesis of modified RNAs of the present invention can involve the protection and deprotection of various chemical groups. The need for protection and deprotection, and the selection of appropriate protecting groups can be readily determined by one skilled in the art.

The chemistry of protecting groups can be found, for example, in Greene, et al., Protective Groups in Organic Synthesis, 2d. Ed., Wiley & Sons, 1991, which is incorporated herein by reference in its entirety.

Modified nucleosides and nucleotides can be prepared according to the synthetic methods described in Ogata et al. Journal of Organic Chemistry 74:2585-2588, 2009; Purmal et al. Nucleic Acids Research 22(1): 72-78, 1994; Fukuhara et al. Biochemistry 1(4): 563-568, 1962; and Xu et al. Tetrahedron 48(9): 1729-1740, 1992, each of which are incorporated by reference in their entirety.

Modified nucleic acids (e.g., ribonucleic acids) need not be uniformly modified along the entire length of the molecule. Different nucleotide modifications and/or backbone structures may exist at various positions in the nucleic acid. One of ordinary skill in the art will appreciate that the nucleotide analogs or other modification(s) may be located at any position(s) of a nucleic acid such that the function of the nucleic acid is not substantially decreased. A modification may also be a 5' or 3' terminal modification. The nucleic acids may contain at a minimum one and at maximum 100% modified nucleotides, or any intervening percentage, such as at least 50% modified nucleotides, at least 80% modified nucleotides, or at least 90% modified nucleotides.

In some embodiments, at least one of the one to two ribonucleic acids is a modified ribonucleic acid. In some embodiments, each of the one to two ribonucleic acids is a modified ribonucleic acid. In some embodiments, at least one of the multiple ribonucleic acids is a modified ribonucleic acid. In some embodiments, a plurality of the multiple ribonucleic acids are modified. In some embodiments, each of the multiple ribonucleic acids are modified. Those skilled in the art will appreciate that the modified ribonucleic acids can include one or more of the nucleic acid modification described herein.

In some aspects, provided herein are synthetic, modified RNA molecules encoding polypeptides, where the synthetic, modified RNA molecules comprise one or more modifications, such that introducing the synthetic, modified RNA molecules to a cell results in a reduced innate immune response relative to a cell contacted with synthetic RNA molecules encoding the polypeptides not comprising the one or more modifications. In some embodiments, the Cas protein comprises a synthetic, modified RNA molecule encoding a Cas protein. In some embodiments, the Cas protein comprises a synthetic, modified RNA molecule encoding a Cas9 protein.

The synthetic, modified RNAs described herein include modifications to prevent rapid degradation by endo- and exo-nucleases and to avoid or reduce the cell's innate immune or interferon response to the RNA. Modifications include, but are not limited to, for example, (a) end modifications, e.g., 5' end modifications (phosphorylation dephosphorylation, conjugation, inverted linkages, etc.), 3' end modifications (conjugation, DNA nucleotides, inverted linkages, etc.), (b) base modifications, e.g., replacement with modified bases, stabilizing bases, destabilizing bases, or bases that base pair with an expanded repertoire of partners, or conjugated bases, (c) sugar modifications (e.g., at the 2' position or 4' position) or replacement of the sugar, as well as (d) internucleoside linkage modifications, including modification or replacement of the phosphodiester linkages. To the extent that such modifications interfere with translation (i.e., results in a reduction of 50% or more in translation relative to the lack of the modification—e.g., in a rabbit reticulocyte in vitro translation assay), the modification is not suitable for the methods and compositions described herein. Specific examples of synthetic, modified RNA compositions useful with the methods described herein include, but are not limited to, RNA molecules containing modified or non-natural internucleoside linkages. Synthetic, modified RNAs having modified internucleoside linkages include, among others, those that do not have a phosphorus atom in the internucleoside linkage. In other embodiments, the synthetic, modified RNA has a phosphorus atom in its internucleoside linkage(s).

Non-limiting examples of modified internucleoside linkages include phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and RE39464, each of which is herein incorporated by reference in its entirety.

Modified internucleoside linkages that do not include a phosphorus atom therein have internucleoside linkages that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of modified oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, each, of which is herein incorporated by reference in its entirety.

Some embodiments of the synthetic, modified RNAs described herein include nucleic acids with phosphorothioate internucleoside linkages and oligonucleosides with heteroatom internucleoside linkage, and in particular $CH_2$-NH—$CH_2$-, —$CH_2$-N($CH_3$)-O—$CH_2$-[known as a methylene (methylimino) or MMI], —$CH_2$-O—N($CH_3$)-$CH_2$-, —$CH_2$-N($CH_3$)-N($CH_3$)-$CH_2$- and —N($CH_3$)-$CH_2$-$CH_2$-[wherein the native phosphodiester internucleoside linkage is represented as —O—P—O—$CH_2$-] of the above-referenced U.S. Pat. No. 5,489,677, and the amide backbones of the above-referenced U.S. Pat. No. 5,602,240, both of which are herein incorporated by reference in their entirety. In some embodiments, the nucleic acid sequences featured herein have morpholino backbone structures of the above-referenced U.S. Pat. No. 5,034,506, herein incorporated by reference in its entirety.

Synthetic, modified RNAs described herein can also contain one or more substituted sugar moieties. The nucleic acids featured herein can include one of the following at the 2' position: H (deoxyribose); OH (ribose); F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted C1 to C10 alkyl or C2 to C10 alkenyl and alkynyl. Exemplary modifications include O[($CH_2$)nO]m$CH_3$, O($CH_2$).nO$CH_3$, O($CH_2$)n$NH_2$, O($CH_2$)n$CH_3$, O($CH_2$)nO$NH_2$, and O($CH_2$)nON[($CH_2$)n$CH_3$)]2, where n and m are from 1 to about 10. In some embodiments, synthetic, modified RNAs include one of the following at the 2' position: C1 to C10 lower alkyl, substituted lower alkyl, alkaryl, aralkyl, O-alkaryl or O-aralkyl, SH, S$CH_3$, OCN, Cl, Br, CN, $CF_3$, O$CF_3$, SO$CH_3$, SO$_2$$CH_3$, ONO$_2$, NO$_2$, N$_3$, NH$_2$, heterocycloalkyl, heterocycloalkaryl, aminoalkylamino, polyalkylamino, substituted silyl, a reporter group, an intercalator, a group for improving the pharmacokinetic properties of an RNA, or a group for improving the pharmacodynamic properties of a synthetic, modified RNA, and other substituents having similar properties. In some embodiments, the modification includes a 2' methoxyethoxy (2'-O—$CH_2$$CH_2$O$CH_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a O($CH_2$)2ON($CH_3$)2 group, also known as 2'-DMAOE, and 2'-dimethylaminoethoxyethoxy (also known in the art as 2'-O-dimethylaminoethoxyethyl or 2'-DMAEOE), i.e., 2'-O—$CH_2$-O—$CH_2$-N($CH_2$)2.

Other modifications include 2'-methoxy (2'-O$CH_3$), 2'-aminopropoxy (2'-O$CH_2$$CH_2$$CH_2$$NH_2$) and 2'-fluoro (2'-F). Similar modifications can also be made at other positions on the nucleic acid sequence, particularly the 3' position of the sugar on the 3' terminal nucleotide or in 2'-5' linked nucleotides and the 5' position of 5' terminal nucleotide. A synthetic, modified RNA can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference in its entirety.

As non-limiting examples, synthetic, modified RNAs described herein can include at least one modified nucleoside including a 2'-O-methyl modified nucleoside, a nucleoside comprising a 5' phosphorothioate group, a 2'-amino-modified nucleoside, 2'-alkyl-modified nucleoside, morpholino nucleoside, a phosphoramidate or a non-natural base comprising nucleoside, or any combination thereof.

In some embodiments of this aspect and all other such aspects described herein, the at least one modified nucleoside is selected from the group consisting of 5-methylcytidine (5mC), N6-methyladenosine (m6A), 3,2'-O-dimethyluridine (m4U), 2-thiouridine (s2U), 2' fluorouridine, pseudouridine, 2'-O-methyluridine (Urn), 2' deoxyuridine (2' dU), 4-thiouridine (s4U), 5-methyluridine (m5U), 2'-O-methyladenosine (m6A), N6,2'-O-dimethyladenosine (m6Am), N6,N6,2'-O-trimethyladenosine (m62Am), 2'-O-methylcytidine (Cm), 7-methylguanosine (m7G), 2'-O-methylguanosine (Gm), N2,7-dimethylguanosine (m2,7G), N2,N2,7-trimethylguanosine (m2,2,7G), and inosine (I).

Alternatively, a synthetic, modified RNA can comprise at least two modified nucleosides, at least 3, at least 4, at least 5, at least 6, at least 7, at least 8, at least 9, at least 10, at least 15, at least 20 or more, up to the entire length of the nucleotide. At a minimum, a synthetic, modified RNA molecule comprising at least one modified nucleoside comprises a single nucleoside with a modification as described herein. It is not necessary for all positions in a given synthetic, modified RNA to be uniformly modified, and in fact more than one of the aforementioned modifications can be incorporated in a single synthetic, modified RNA or even at a single nucleoside within a synthetic, modified RNA. However, it is preferred, but not absolutely necessary, that each occurrence of a given nucleoside in a molecule is modified (e.g., each cytosine is a modified cytosine e.g., 5mC). However, it is also contemplated that different occurrences of the same nucleoside can be modified in a different way in a given synthetic, modified RNA molecule (e.g., some cytosines modified as 5mC, others modified as 2'-O-methylcytidine or other cytosine analog). The modifications need not be the same for each of a plurality of modified nucleosides in a synthetic, modified RNA. Furthermore, in some embodiments of the aspects described herein, a synthetic, modified RNA comprises at least two different modified nucleosides. In some such preferred embodiments of the aspects described herein, the at least two different modified nucleosides are 5-methylcytidine and pseudouridine. A synthetic, modified RNA can also contain a mixture of both modified and unmodified nucleosides.

As used herein, "unmodified" or "natural" nucleosides or nucleobases include the purine bases adenine (A) and guanine (G), and the pyrimidine bases thymine (T), cytosine (C) and uracil (U). In some embodiments, a synthetic, modified RNA comprises at least one nucleoside ("base") modification or substitution. Modified nucleosides include other synthetic and natural nucleobases such as inosine, xanthine, hypoxanthine, nebularine, isoguanisine, tubercidine, 2-(halo)adenine, 2-(alkyl)adenine, 2-(propyl)adenine, 2 (amino)adenine, 2-(aminoalkyl)adenine, 2 (aminopropyl) adenine, 2 (methylthio) N6 (isopentenyl)adenine, 6 (alkyl) adenine, 6 (methyl)adenine, 7 (deaza)adenine, 8 (alkenyl) adenine, 8-(alkyl)adenine, 8 (alkynyl)adenine, 8 (amino) adenine, 8-(halo)adenine, 8-(hydroxyl)adenine, 8 (thioalkyl) adenine, 8-(thiol)adenine, N6-(isopentyl)adenine, N6 (methyl)adenine, N6, N6 (dimethyl)adenine, 2-(alkyl)guanine, 2 (propyl)guanine, 6-(alkyl)guanine, 6 (methyl)guanine, 7 (alkyl)guanine, 7 (methyl)guanine, 7 (deaza)guanine, 8 (alkyl)guanine, 8-(alkenyl)guanine, 8 (alkynyl)guanine, 8-(amino)guanine, 8 (halo)guanine, 8-(hydroxyl)guanine, 8 (thioalkyl)guanine, 8-(thiol)guanine, N (methyl)guanine, 2-(thio)cytosine, 3 (deaza) 5 (azo)cytosine, 3-(alkyl)cytosine, 3 (methyl)cytosine, 5-(alkyl)cytosine, 5-(alkynyl)cytosine, 5 (halo)cytosine, 5 (methyl)cytosine, 5 (propynyl) cytosine, 5 (propynyl)cytosine, 5 (trifluoromethyl)cytosine, 6-(azo)cytosine, N4 (acetyl)cytosine, 3 (3 amino-3 carboxypropyl)uracil, 2-(thio)uracil, 5 (methyl) 2 (thio)uracil, 5 (methylaminomethyl)-2 (thio)uracil, 4-(thio)uracil, 5 (methyl) 4 (thio)uracil, 5 (methylaminomethyl)-4 (thio)uracil, 5 (methyl) 2,4 (dithio)uracil, (methylaminomethyl)-2,4 (dithio)uracil, 5 (2-aminopropyl)uracil, 5-(alkyl)uracil, 5-(alkynyl)uracil, 5-(allylamino)uracil, 5 (aminoallyl)uracil, 5 (aminoalkyl)uracil, 5 (guanidiniumalkyl)uracil, 5 (1,3-diazole-1-alkyl)uracil, 5-(cyanoalkyl)uracil, 5-(dialkylaminoalkyl)uracil, 5 (dimethylaminoalkyl)uracil, 5-(halo)uracil, 5-(methoxy)uracil, uracil-5 oxyacetic acid, 5 (methoxycarbonylmethyl)-2-(thio)uracil, 5 (methoxycarbonyl-methyl)uracil, 5 (propynyl)uracil, 5 (propynyl)uracil, 5 (trifluoromethyl)uracil, 6 (azo)uracil, dihydrouracil, N3 (methyl)uracil, 5-uracil (i.e., pseudouracil), 2 (thio)pseudouracil, 4 (thio)pseudouracil, 2,4-(dithio)psuedouracil, 5-(alkyl)pseudouracil, 5-(methyl)pseudouracil, 5-(alkyl)-2-(thio)pseudouracil, 5-(methyl)-2-(thio)pseudouracil, 5-(alkyl)-4 (thio)pseudouracil, 5-(methyl)-4 (thio)pseudouracil, 5-(alkyl)-2,4 (dithio)pseudouracil, 5-(methyl)-2,4 (dithio)pseudouracil, 1 substituted pseudouracil, 1 substituted 2(thio)-pseudouracil, 1 substituted 4 (thio)pseudouracil, 1 substituted 2,4-(dithio)pseudouracil, 1 (aminocarbonylethylenyl)-pseudouracil, 1 (aminocarbonylethylenyl)-2(thio)-pseudouracil, 1 (aminocarbonylethylenyl)-4 (thio)pseudouracil, 1 (aminocarbonylethylenyl)-2,4-(dithio)pseudouracil, 1 (aminoalkylaminocarbonylethylenyl)-pseudouracil, 1 (aminoalkylaminocarbonylethylenyl)-2(thio)-pseudouracil, 1 (aminoalkylaminocarbonylethylenyl)-4 (thio)pseudouracil, 1 (aminoalkylaminocarbonylethylenyl)-2,4-(dithio) pseudouracil, 1,3-(diaza)-2-(oxo)-phenoxazin-1-yl, 1-(aza)-2-(thio)-3-(aza)-phenoxazin-1-yl, 1,3-(diaza)-2-(oxo)-phenthiazin-1-yl, 1-(aza)-2-(thio)-3-(aza)-phenthiazin-1-yl, 7-substituted 1,3-(diaza)-2-(oxo)-phenoxazin-1-yl, 7-substituted 1-(aza)-2-(thio)-3-(aza)-phenoxazin-1-yl, 7-substituted 1,3-(diaza)-2-(oxo)-phenthiazin-1-yl, 7-substituted 1-(aza)-2-(thio)-3-(aza)-phenthiazin-1-yl, 7-(aminoalkylhydroxy)-1,3-(diaza)-2-(oxo)-phenoxazin-1-yl, 7-(aminoalkylhydroxy)-1-(aza)-2-(thio)-3-(aza)-phenoxazin-1-yl, 7-(aminoalkylhydroxy)-1,3-(diaza)-2-(oxo)-phenthiazin-1-yl, 7-(aminoalkylhydroxy)-1-(aza)-2-(thio)-3-(aza)-phenthiazin-1-yl, 7-(guanidiniumalkylhydroxy)-1,3-(diaza)-2-(oxo)-phenoxazin-1-yl, 7-(guanidiniumalkylhydroxy)-1-(aza)-2-(thio)-3-(aza)-phenoxazin-1-yl, 7-(guanidiniumalkylhydroxy)-1,3-(diaza)-2-(oxo)-phenthiazin-1-yl, 7-(guanidiniumalkylhydroxy)-1-(aza)-2-(thio)-3-(aza)-phenthiazin-1-yl, 1,3,5-(triaza)-2,6-(dioxa)-naphthalene, inosine, xanthine, hypoxanthine, nubularine, tubercidine, isoguanisine, inosinyl, 2-aza-inosinyl, 7-deaza-inosinyl, nitroimidazolyl, nitropyrazolyl, nitrobenzimidazolyl, nitroindazolyl, aminoindolyl, pyrrolopyrimidinyl, 3-(methyl)isocarbostyrilyl, 5-(methyl)isocarbostyrilyl, 3-(methyl)-7-(propynypisocarbostyrilyl, 7-(aza)indolyl, 6-(methyl)-7-(aza)indolyl, imidizopyridinyl, 9-(methyl)-imidizopyridinyl, pyrrolopyrizinyl, isocarbostyrilyl, 7-(propynyl)isocarbostyrilyl, propynyl-7-(aza)indolyl, 2,4,5-(trimethyl)phenyl, 4-(methyl)indolyl, 4,6-(dimethyl)indolyl, phenyl, napthalenyl, anthracenyl, phenanthracenyl, pyrenyl, stilbenzyl, tetracenyl, pentacenyl, difluorotolyl, 4-(fluoro)-6-(methyl)benzimidazole, 4-(methyl)benzimidazole, 6-(azo) thymine, 2-pyridinone, 5 nitroindole, 3 nitropyrrole, 6-(aza)

pyrimidine, 2 (amino)purine, 2,6-(diamino)purine, 5 substituted pyrimidines, N2-substituted purines, N6-substituted purines, 06-substituted purines, substituted 1,2,4-triazoles, pyrrolo-pyrimidin-2-on-3-yl, 6-phenyl-pyrrolo-pyrimidin-2-on-3-yl, para-substituted-6-phenyl-pyrrolo-pyrimidin-2-on-3-yl, ortho-substituted-6-phenyl-pyrrolo-pyrimidin-2-on-3-yl, bis-ortho-substituted-6-phenyl-pyrrolo-pyrimidin-2-on-3-yl, para-(aminoalkylhydroxy)-6-phenyl-pyrrolo-pyrimidin-2-on-3-yl, ortho-(aminoalkylhydroxy)-6-phenyl-pyrrolo-pyrimidin-2-on-3-yl, bis-ortho-(aminoalkylhydroxy)-6-phenyl-pyrrolo-pyrimidin-2-on-3-yl, pyridopyrimidin-3-yl, 2-oxo-7-amino-pyridopyrimidin-3-yl, 2-oxo-pyridopyrimidine-3-yl, or any O-alkylated or N-alkylated derivatives thereof. Modified nucleosides also include natural bases that comprise conjugated moieties, e.g. a ligand. As discussed herein above, the RNA containing the modified nucleosides must be translatable in a host cell (i.e., does not prevent translation of the polypeptide encoded by the modified RNA). For example, transcripts containing s2U and m6A are translated poorly in rabbit reticulocyte lysates, while pseudouridine, m5U, and m5C are compatible with efficient translation. In addition, it is known in the art that 2'-fluoro-modified bases useful for increasing nuclease resistance of a transcript, leads to very inefficient translation. Translation can be assayed by one of ordinary skill in the art using e.g., a rabbit reticulocyte lysate translation assay.

Further modified nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in Int. Appl. No. PCT/US09/038,425, filed Mar. 26, 2009; those disclosed in The Concise Encyclopedia Of Polymer Science And Engineering, pages 858-859, Kroschwitz, J. L, ed. John Wiley & Sons, 1990, and those disclosed by Englisch et al., Angewandte Chemie, International Edition, 1991, 30, 613.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,457,191; 5,459,255; 5,484,908; 5,502,177; 5,525,711; 5,552,540; 5,587,469; 5,594,121, 5,596,091; 5,614,617; 5,681,941; 6,015,886; 6,147,200; 6,166,197; 6,222,025; 6,235,887; 6,380,368; 6,528,640; 6,639,062; 6,617,438; 7,045,610; 7,427,672; and 7,495,088, each of which is herein incorporated by reference in its entirety, and U.S. Pat. No. 5,750,692, also herein incorporated by reference in its entirety.

Another modification for use with the synthetic, modified RNAs described herein involves chemically linking to the RNA one or more ligands, moieties or conjugates that enhance the activity, cellular distribution or cellular uptake of the RNA. Ligands can be particularly useful where, for example, a synthetic, modified RNA is administered in vivo. Such moieties include but are not limited to lipid moieties such as a cholesterol moiety (Letsinger et al., Proc. Natl. Acid. Sci. USA, 1989, 86: 6553-6556, herein incorporated by reference in its entirety), cholic acid (Manoharan et al., Biorg. Med. Chem. Let., 1994, 4:1053-1060, herein incorporated by reference in its entirety), a thioether, e.g., beryl-S-tritylthiol (Manoharan et al., Ann. N.Y. Acad. Sci., 1992, 660:306-309; Manoharan et al., Biorg. Med. Chem. Let., 1993, 3:2765-2770, each of which is herein incorporated by reference in its entirety), a thiocholesterol (Oberhauser et al., Nucl. Acids Res., 1992, 20:533-538, herein incorporated by reference in its entirety), an aliphatic chain, e.g., dodecan-diol or undecyl residues (Saison-Behmoaras et al., EMBO J, 1991, 10:1111-1118; Kabanov et al., FEBS Lett., 1990, 259:327-330; Svinarchuk et al., Biochimie, 1993, 75:49-54, each of which is herein incorporated by reference in its entirety), a phospholipid, e.g., di-hexadecyl-rac-glycerol or triethyl-ammonium 1,2-di-O-hexadecyl-rac-glycero-3-phosphonate (Manoharan et al., Tetrahedron Lett., 1995, 36:3651-3654; Shea et al., Nucl. Acids Res., 1990, 18:3777-3783, each of which is herein incorporated by reference in its entirety), a polyamine or a polyethylene glycol chain (Manoharan et al., Nucleosides & Nucleotides, 1995, 14:969-973, herein incorporated by reference in its entirety), or adamantane acetic acid (Manoharan et al., Tetrahedron Lett., 1995, 36:3651-3654, herein incorporated by reference in its entirety), a palmityl moiety (Mishra et al., Biochim. Biophys. Acta, 1995, 1264:229-237, herein incorporated by reference in its entirety), or an octadecylamine or hexylamino-carbonyloxycholesterol moiety (Crooke et al., J. Pharmacol. Exp. Ther., 1996, 277:923-937, herein incorporated by reference in its entirety).

The synthetic, modified RNAs described herein can further comprise a 5' cap. In some embodiments of the aspects described herein, the synthetic, modified RNAs comprise a 5' cap comprising a modified guanine nucleotide that is linked to the 5' end of an RNA molecule using a 5'-5' triphosphate linkage. As used herein, the term "5' cap" is also intended to encompass other 5' cap analogs including, e.g., 5' diguanosine cap, tetraphosphate cap analogs having a methylene-bis(phosphonate) moiety (see e.g., Rydzik, A M et al., (2009) Org Biomol Chem 7(22):4763-76), dinucleotide cap analogs having a phosphorothioate modification (see e.g., Kowalska, J. et al., (2008) RNA 14(6):1119-1131), cap analogs having a sulfur substitution for a non-bridging oxygen (see e.g., Grudzien-Nogalska, E. et al., (2007) RNA 13(10): 1745-1755), N7-benzylated dinucleoside tetraphosphate analogs (see e.g., Grudzien, E. et al., (2004) RNA 10(9):1479-1487), or anti-reverse cap analogs (see e.g., Jemielity, J. et al., (2003) RNA 9(9): 1108-1122 and Stepinski, J. et al., (2001) RNA 7(10):1486-1495). In one such embodiment, the 5' cap analog is a 5' diguanosine cap. In some embodiments, the synthetic, modified RNA does not comprise a 5' triphosphate.

The 5' cap is important for recognition and attachment of an mRNA to a ribosome to initiate translation. The 5' cap also protects the synthetic, modified RNA from 5' exonuclease mediated degradation. It is not an absolute requirement that a synthetic, modified RNA comprise a 5' cap, and thus in other embodiments the synthetic, modified RNAs lack a 5' cap. However, due to the longer half-life of synthetic, modified RNAs comprising a 5' cap and the increased efficiency of translation, synthetic, modified RNAs comprising a 5' cap are preferred herein.

The synthetic, modified RNAs described herein can further comprise a 5' and/or 3' untranslated region (UTR). Untranslated regions are regions of the RNA before the start codon (5') and after the stop codon (3'), and are therefore not translated by the translation machinery. Modification of an RNA molecule with one or more untranslated regions can improve the stability of an mRNA, since the untranslated regions can interfere with ribonucleases and other proteins involved in RNA degradation. In addition, modification of an RNA with a 5' and/or 3' untranslated region can enhance translational efficiency by binding proteins that alter ribosome binding to an mRNA. Modification of an RNA with a 3' UTR can be used to maintain a cytoplasmic localization of the RNA, permitting translation to occur in the cytoplasm of the cell. In one embodiment, the synthetic, modified RNAs described herein do not comprise a 5' or 3' UTR. In another embodiment, the synthetic, modified RNAs comprise either a 5' or 3' UTR. In another embodiment, the synthetic, modified RNAs described herein comprise both a 5' and a 3' UTR. In one embodiment, the 5' and/or 3' UTR is selected from an mRNA known to have high stability in the cell (e.g., a murine alpha-globin 3' UTR). In some embodiments, the 5' UTR, the 3' UTR, or both comprise one or more modified nucleosides.

In some embodiments, the synthetic, modified RNAs described herein further comprise a Kozak sequence. The "Kozak sequence" refers to a sequence on eukaryotic mRNA having the consensus (gcc)gccRccAUGG SEQ ID NO: 1481, where R is a purine (adenine or guanine) three bases upstream of the start codon (AUG), which is followed by another 'G'. The Kozak consensus sequence is recognized by the ribosome to initiate translation of a polypeptide. Typically, initiation occurs at the first AUG codon encountered by the translation machinery that is proximal to the 5' end of the transcript. However, in some cases, this AUG codon can be bypassed in a process called leaky scanning. The presence of a Kozak sequence near the AUG codon will strengthen that codon as the initiating site of translation, such that translation of the correct polypeptide occurs. Furthermore, addition of a Kozak sequence to a synthetic, modified RNA will promote more efficient translation, even if there is no ambiguity regarding the start codon. Thus, in some embodiments, the synthetic, modified RNAs described herein further comprise a Kozak consensus sequence at the desired site for initiation of translation to produce the correct length polypeptide. In some such embodiments, the Kozak sequence comprises one or more modified nucleosides.

In some embodiments, the synthetic, modified RNAs described herein further comprise a "poly (A) tail", which refers to a 3' homopolymeric tail of adenine nucleotides, which can vary in length (e.g., at least 5 adenine nucleotides) and can be up to several hundred adenine nucleotides). The inclusion of a 3' poly(A) tail can protect the synthetic, modified RNA from degradation in the cell, and also facilitates extra-nuclear localization to enhance translation efficiency. In some embodiments, the poly(A) tail comprises between 1 and 500 adenine nucleotides; in other embodiments the poly(A) tail comprises at least 5, at least 10, at least 20, at least 30, at least 40, at least 50, at least 60, at least 70, at least 80, at least 90, at least 100, at least 110, at least 120, at least 130, at least 140, at least 150, at least 160, at least 170, at least 180, at least 190, at least 200, at least 225, at least 250, at least 275, at least 300, at least 325, at least 350, at least 375, at least 400, at least 425, at least 450, at least 475, at least 500 adenine nucleotides or more. In one embodiment, the poly(A) tail comprises between 1 and 150 adenine nucleotides. In another embodiment, the poly(A) tail comprises between 90 and 120 adenine nucleotides. In some such embodiments, the poly(A) tail comprises one or more modified nucleosides.

It is contemplated that one or more modifications to the synthetic, modified RNAs described herein permit greater stability of the synthetic, modified RNA in a cell. To the extent that such modifications permit translation and either reduce or do not exacerbate a cell's innate immune or interferon response to the synthetic, modified RNA with the modification, such modifications are specifically contemplated for use herein. Generally, the greater the stability of a synthetic, modified RNA, the more protein can be produced from that synthetic, modified RNA. Typically, the presence of AU-rich regions in mammalian mRNAs tend to destabilize transcripts, as cellular proteins are recruited to AU-rich regions to stimulate removal of the poly(A) tail of the transcript. Loss of a poly(A) tail of a synthetic, modified RNA can result in increased RNA degradation. Thus, in one embodiment, a synthetic, modified RNA as described herein does not comprise an AU-rich region. In particular, it is preferred that the 3' UTR substantially lacks AUUUA sequence elements.

In one embodiment, a ligand alters the cellular uptake, intracellular targeting or half-life of a synthetic, modified RNA into which it is incorporated. In some embodiments a ligand provides an enhanced affinity for a selected target, e.g., molecule, cell or cell type, intracellular compartment, e.g., mitochondria, cytoplasm, peroxisome, lysosome, as, e.g., compared to a composition absent such a ligand. Preferred ligands do not interfere with expression of a polypeptide from the synthetic, modified RNA.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand can also be a recombinant or synthetic molecule, such as a synthetic polymer, e.g., a synthetic polyamino acid. Examples of polyamino acids include polylysine (PLL), poly L aspartic acid, poly L-glutamic acid, styrene-maleic acid anhydride copolymer, poly(L-lactide-co-glycolied) copolymer, divinyl ether-maleic anhydride copolymer, N-(2-hydroxypropyl) methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell targeting agent, (e.g., a lectin, glycoprotein, lipid or protein), or an antibody, that binds to a specified cell type such as a fibroblast cell. A targeting group can be, for example, a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or ROD peptide mimetic, among others.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, amino, mercapto, PEG (e.g., PEG-40K), MPEG, [MPEG]2, polyamino, alkyl, substituted alkyl, radiolabeled markers, enzymes, haptens (e.g. biotin), and transport/absorption facilitators (e.g., aspirin, vitamin E, folic acid).

Ligands can be proteins, e.g., glycoproteins, or peptides, e.g., molecules having a specific affinity for a co-ligand, or antibodies e.g., an antibody, that binds to a specified cell type such as a fibroblast cell, or other cell useful in the production of polypeptides. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose.

The ligand can be a substance, e.g., a drug, which can increase the uptake of the synthetic, modified RNA or a composition thereof into the cell, for example, by disrupting the cell's cytoskeleton, e.g., by disrupting the cell's microtubules, microfilaments, and/or intermediate filaments. The drug can be, for example, taxol, vincristine, vinblastine, cytochalasin, nocodazole, japlakinolide, latrunculin A, phalloidin, swinholide A, indanocine, or myoservin.

One exemplary ligand is a lipid or lipid-based molecule. A lipid or lipid-based ligand can (a) increase resistance to degradation, and/or (b) increase targeting or transport into a target cell or cell membrane. A lipid based ligand can be used to modulate, e.g., binding of the modified RNA composition to a target cell.

In another aspect, the ligand is a moiety, e.g., a vitamin, which is taken up by a host cell. Exemplary vitamins include vitamin A, E, and K. Other exemplary vitamins include B vitamin, e.g., folic acid, B12, riboflavin, biotin, pyridoxal or other vitamins or nutrients taken up, for example, by cancer cells. Also included are HSA and low density lipoprotein (LDL).

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, nonpeptide or pseudo-peptide linkages, and use of D-amino acids. The helical agent is preferably an alpha-helical agent, which preferably has a lipophilic and a lipophobic phase.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

The synthetic, modified RNAs described herein can be synthesized and/or modified by methods well established in the art, such as those described in "Current Protocols in Nucleic Acid Chemistry," Beaucage, S. L. et al. (Edrs.), John Wiley & Sons, Inc., New York, N.Y., USA, which is hereby incorporated herein by reference in its entirety. Transcription methods are described further herein in the Examples.

In one embodiment of the aspects described herein, a template for a synthetic, modified RNA is synthesized using "splint-mediated ligation," which allows for the rapid synthesis of DNA constructs by controlled concatenation of long oligos and/or dsDNA PCR products and without the need to introduce restriction sites at the joining regions. It can be used to add generic untranslated regions (UTRs) to the coding sequences of genes during T7 template generation. Splint mediated ligation can also be used to add nuclear localization sequences to an open reading frame, and to make dominant-negative constructs with point mutations starting from a wild-type open reading frame. Briefly, single-stranded and/or denatured dsDNA components are annealed to splint oligos which bring the desired ends into conjunction, the ends are ligated by a thermostable DNA ligase and the desired constructs amplified by PCR. A synthetic, modified RNA is then synthesized from the template using an RNA polymerase in vitro. After synthesis of a synthetic, modified RNA is complete, the DNA template is removed from the transcription reaction prior to use with the methods described herein.

In some embodiments of these aspects, the synthetic, modified RNAs are further treated with an alkaline phosphatase.)

One skilled in the art readily appreciates that the present invention is well adapted to carry out the objects and obtain the ends and advantages mentioned, as well as those inherent therein. The details of the description and the examples herein are representative of certain embodiments, are exemplary, and are not intended as limitations on the scope of the invention. Modifications therein and other uses will occur to those skilled in the art. These modifications are encompassed within the spirit of the invention. It will be readily apparent to a person skilled in the art that varying substitutions and modifications may be made to the invention disclosed herein without departing from the scope and spirit of the invention.

The articles "a" and "an" as used herein in the specification and in the claims, unless clearly indicated to the contrary, should be understood to include the plural referents. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or all of the group members are present in, employed in, or otherwise relevant to a given product or process. Furthermore, it is to be understood that the invention provides all variations, combinations, and permutations in which one or more limitations, elements, clauses, descriptive terms, etc., from one or more of the listed claims is introduced into another claim dependent on the same base claim (or, as relevant, any other claim) unless otherwise indicated or unless it would be evident to one of ordinary skill in the art that a contradiction or inconsistency would arise. It is contemplated that all embodiments described herein are applicable to all different aspects of the invention where appropriate. It is also contemplated that any of the embodiments or aspects can be freely combined with one or more other such embodiments or aspects whenever appropriate. Where elements are presented as lists, e.g., in Markush group or similar format, it is to be understood that each subgroup of the elements is also disclosed, and any element(s) can be removed from the group. It should be understood that, in general, where the invention, or aspects of the invention, is/are referred to as comprising particular elements, features, etc., certain embodiments of the invention or aspects of the invention consist, or consist essentially of such elements, features, etc. For purposes of simplicity those embodiments have not in every case been specifically set forth in so many words herein. It should also be understood that any embodiment or aspect of the invention can be explicitly excluded from the claims, regardless of whether the specific exclusion is recited in the specification. For example, any one or more active agents, additives, ingredients, optional agents, types of organism, disorders, subjects, or combinations thereof, can be excluded.

Where the claims or description relate to a composition of matter, it is to be understood that methods of making or using the composition of matter according to any of the methods disclosed herein, and methods of using the composition of matter for any of the purposes disclosed herein are aspects of the invention, unless otherwise indicated or unless it would be evident to one of ordinary skill in the art that a contradiction or inconsistency would arise. Where the claims or description relate to a method, e.g., it is to be understood that methods of making compositions useful for performing the method, and products produced according to the method, are aspects of the invention, unless otherwise indicated or unless it would be evident to one of ordinary skill in the art that a contradiction or inconsistency would arise.

Where ranges are given herein, the invention includes embodiments in which the endpoints are included, embodiments in which both endpoints are excluded, and embodiments in which one endpoint is included and the other is excluded. It should be assumed that both endpoints are included unless indicated otherwise. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise. It is also understood that where a series of numerical values is stated herein, the invention includes embodiments that relate analogously to any intervening value or range defined by any two values in the series, and that the lowest value may be taken as a minimum and the greatest value may be taken as a maximum. Numerical values, as used herein, include values expressed as percentages. For any embodiment of the invention in which a numerical value is prefaced by "about" or "approximately", the invention includes an embodiment in which the exact value is recited. For any embodiment of the invention in which a numerical value is not prefaced by "about" or "approximately", the invention includes an embodiment in which the value is prefaced by "about" or "approximately".

"Approximately" or "about" generally includes numbers that fall within a range of 1% or in some embodiments within a range of 5% of a number or in some embodiments within a range of 10% of a number in either direction (greater than or less than the number) unless otherwise stated or otherwise evident from the context (except where such number would impermissibly exceed 100% of a possible value). It should be understood that, unless clearly indicated to the contrary, in any methods claimed herein that include more than one act, the order of the acts of the method is not necessarily limited to the order in which the acts of the method are recited, but the invention includes embodiments in which the order is so limited. It should also be understood that unless otherwise indicated or evident from the context, any product or composition described herein may be considered "isolated".

As used herein the term "comprising" or "comprises" is used in reference to compositions, methods, and respective component(s) thereof, that are essential to the invention, yet open to the inclusion of unspecified elements, whether essential or not.

As used herein the term "consisting essentially of" refers to those elements required for a given embodiment. The term permits the presence of additional elements that do not materially affect the basic and novel or functional characteristic(s) of that embodiment of the invention.

The term "consisting of" refers to compositions, methods, and respective components thereof as described herein, which are exclusive of any element not recited in that description of the embodiment.

\*\*\*

EXAMPLES

Example 1

Transcription activator-like effector nucleases (TALENs) bind as a pair around a genomic site, in which a double-strand break (DSB) is introduced by a dimer of FokI nuclease domains. The use of a TALEN genome-editing system to rapidly and efficiently generate mutant alleles of 15 different genes in human pluripotent stem cells (hPSCs) as a means of performing rigorous disease modeling was recently reported (Ding et al., Cell Stem Cell 12:238-251 (2013)); the proportions of clones bearing at least one mutant allele ranged from 2%-34%.

As described below, the relative efficacies of CRISPRs and TALENs targeting the same genomic sites in the same hPSC lines was assessed with the use of the same delivery platform described previously (Ding et al., Cell Stem Cell 12:238-251 (2013)). In the TALEN genome-editing system, the CAG promoter was used to co-translate (via a viral 2A peptide) each TALEN with green fluorescent protein (GFP) or red fluorescent protein (RFP). For CRISPRs, a human codon-optimized Cas9 gene was subcloned with a C-terminal nuclear localization signal (Mali et al., Science 339:823-826 (2013)) into the same CAG expression plasmid with GFP, and the guide RNA (gRNA) was separately expressed from a plasmid with the human U6 polymerase III promoter (Mali et al., Science 339:823-826 (2013)). The 20-nucleotide protospacer sequence for each gRNA was introduced using polymerase chain reaction (PCR)-based methods. Whether using TALENs or CRISPRs, equal amounts of the two plasmids were co-electroporated into hPSCs (either 25 µg of each plasmid, or 12.5 µg of each plasmid along with 25 µg of a DNA repair template if attempting knock-in) followed by fluorescence-activated cell sorting (FACS) after 24-48 hours, clonal expansion of single cells, and screening for mutations at the genomic target site via PCR.

gRNAs were designed matching G(N)19NGG sequences in seven loci in six genes (AKT2, CELSR2, CIITA, GLUT4, LINC00116, and SORT1) previously successfully targeted with TALENs (Ding et al., Cell Stem Cell 12:238-251 (2013)) and one additional locus in LDLR. In this system, CRISPRs consistently and substantially outperformed TALENs across loci and hPSC lines (see Table S1). The TALENs yielded clones with at least one mutant allele at efficiencies of 0%-34%, but matched CRISPRs yielded mutant clones at efficiencies of 51%-79% (Table SI). Just as with TALENs, CRISPRs produced a variety of indels of sizes ranging from one nucleotide to several dozen nucleotides in size, centered on the predicted cleavage sites, suggesting that non-homologous end-joining mutagenesis occurs in the same way regardless of whether CRISPRs or TALENs are used. Moreover, CRISPRs readily generated homozygous mutant clones (7%-25% of all clones; Table S1) as discerned by sequencing.

Knock-in of E17K mutations into AKT2 was also attempted using a 67-nucleotide single-stranded DNA oligonucleotide as previously described (Ding et al., Cell Stem Cell 12:238-251 (2013)). Although the predicted CRISPR cleavage site lay 11 and 13 nucleotides from the point mutations, respectively, the CRISPR yielded knock-in clones at a rate of 11%, whereas TALENs yielded only 1.6% (Table SI).

TABLE S1

Targeting Efficiency of CRISPRs Versus TALENs in Human Pluripotent Stem Cells

| Gene | Chromosome:Position (Start of Target Sequence) | Target Sequence[a] | Cell Line[b] | TALENs Efficiency (Mutants/Clones Screened)[c] | CRISPRs Efficiency (Mutants/Clones Screened)[c] | CRISPRs Efficiency of Homozygous Mutants |
|---|---|---|---|---|---|---|
| AKT2 | chr19:40762982 | TCCCTTCCTGCCTCATTTCAGGTGAATACATCAAGACCTGGAGGCCA | HUES 9 | 8.9% (17/192) | (SEQ ID NO: 335) | |
| AKT2 | chr19:40762982 | TCCCTTCCTGCCTCATTTCAGGTGAATACATCAAGACCTGGAGGCCA | HUES 9 | (SEQ ID NO: 336) | 60.6% (86/142) | 12.7% (18/142) |
| CELSR2 | chr1:109817568 | TGCTGGCTCGGCTCCCTGAGGTTGCTCTCAATCAAGCACAGGTTTCAA | HUES 1 | 3.5% (18/506) | (SEQ ID NO: 337) | |
| CELSR2 | chr1:109817568 | TGCTGGCTCGGCTCCCTGAGGTTGCTCAATCAAGICACAGGTTTCAA | HUES 1 | (SEQ ID NO: 338) | 66.2% (45/68) | 7.4% (5/68) |
| CIITA | chr16:10989200 | TAACAGCGATGCTGACCCCCTGTGCCTCTACCACTTCTATGACCAGA | BJ-RiPS | 12.7% (37/292) | (SEQ ID NO: 339) | |
| CIITA | chr16:10989206 | CGATGCTGACCCCCTGTGCCTCTACCACTTTCTATGACCAGATGACC | BJ-RiPS | (SEQ ID NO: 340) | 78.7% (96/122) | 11.5% (14/122) |
| GLUT4 | chr17:7186601 | TGGTCCTTGCTGTGTCTCTGCGGTGCTTGGCTCCCTGCAGTTTGGGTA | HUES 9 | 33.5% (52/155) | (SEQ ID NO: 341) | |
| GLUT4 | chr17:7186601 | TGGTCCTTGCTGTGTTCTTCTGCGGTGCTTGGCTCCCTGCAGTTTGGGTA | HUES 9 | (SEQ ID NO: 342) | 66.5% (123/185) | 24.9% (46/185) |
| LDLR | chr19:11210899 | TGGGCGACAGATGCGAAAGAAACAGAGTTCCAGTGCCAAGACGGAAA | HUES 9 | 0% (0/568) | (SEQ ID NO: 343) | |
| LDLR | chr19:11210917 | GAAACGAGTTCCAGTGCCAAGACGGAAAATGCATCTCCTACIAAGTGG | HUES 9 | (SEQ ID NO: 344) | 51.1% (90/176) | 8.0% (14/176) |
| LINC00116 | chr2:110970090 | TCAGAGAGGACACTGCAGTTGTCCGTGCTAGTAGCCTTCGCTTCTGA | HUES 9 | 29.5% (26/88) | (SEQ ID NO: 345) | |
| LINC00116 | chr2:110970090 | TCAGAGAGGACACTGCAGTTGTCCGTGCTAGTAGCCTTCGCITTCTGGA | HUES 9 | (SEQ ID NO: 346) | 57.4% (93/162) | 8.6% (14/162) |
| SORT1 exon 2 | chr1:109912203 | TGATGATCTCAGAGGCTCAGTATCCTTGTCCTGGGTTGGAGATAGCA | HUES 1 | 22.2% (128/576) | (SEQ ID NO: 347) | |
| SORT1 exon 2 | chr1:109912203 | TGATGATCTCAGAGGCTCAGTATCCTTGTTCCTGGGTTGGAGATAGCA | HUES 1 | (SEQ ID NO: 348) | 68.5% (100/146) | 13.0% (19/145) |
| SORT1 exon 3 | chr1:109910069 | TGGTAATTATGACTTTTGGACAGTCCAAGCTATATCGAAGGTGAGATCA | HUES 9 | 10.9% (21/192) | (SEQ ID NO: 349) | |
| SORT1 exon 3 | chr1:109910069 | TGGTAATTATGACTTTTGGACAGTCCAAGCTATATTCGAAGGTGAGATCA | HUES 9 | (SEQ ID NO: 350) | 75.9% (148/195) | 10.3% (20/195) |
| AKT2 E17K | chr19:40762982 | TCCCTTCCTGCCTCATTTCAGGTGAATACATCAAGACCTGGAGGCCA | HUES 9 | 1.6% (3/192)[c] | (SEQ ID NO: 351) | |
| ALT2 E17K | chr19:40762982 | TCCCTTCCTCCTTCATTTCAGGTGAATACATCAAGACCTGGAGGCCA | HUES 9 | (SEQ ID NO: 352) | 10.6% (10/94)[c] | 1.1% (1/94)[d] |
| AKT2 off-target | chr5:22683972 | CTATGCCCTCCTTCATTTCAGTTCAGTGAAGA*T*GAAATCCCTGGAGCTTGG | HUES 9 | (SEQ ID NO: 353) | 0% (0/142) | 0% (0/142) |

[a]For TALENs, the binding sites are indicated with underlines, with the cleavage site predicted to be midway between the binding sites; for CRISPRs, the protospacer is underlined, the NGG motif is in bold (maybe on the antisense strand), and the predicted cleavage site is indicated with 'I'; for the ALT2 E17K target sequence, the sites of the knock-in mutations are indicated in bold/italics; for the AKT2 off-target site, the two mismatches in the protospacer are indicated in bold/italics
[b]HUES 1 and HUES 9 are human embryonic stem cell lines; BJ-RiPS is an induced pluripotent stem cell line
[c]Mutants include single heterozygotes, compound heterozygotes, and homozygous mutants; TALEN data is from Table 1 of Ding et al. (2013), with the exception of LDLR
[d]Successfully inserted E17K knock-in mutations into an AKT2 allele(s) using single-stranded DNA oligonucleotide (refer to FIG. 3 of Ding et al. 2013)

It is worth noting that the requirement for a G(N)19NGG target sequence somewhat limits site selection. Because either DNA strand can be targeted, a target sequence occurs on average every 32 basepairs. This is no barrier for gene knockout, where any coding sequence can be targeted, but it may present difficulties when trying to knock in or correct a mutation at a specific location. However, the requirement for a G at the start of the protospacer is dictated by the use of the U6 promoter to express the gRNA, and alternative CRISPR/Cas systems can relieve this requirement (Cong et al., Science 339:819-823 (2013)). This allows for the use of (N)20NGG target sequences, which are found on average every 8 basepairs.

In addition, the extent of CRISPR off-target effects remains to be defined and is highly sequence-dependent. Previous analyses have suggested that one-nucleotide mismatches in the first half of the protospacer are better tolerated than mismatches in second half (Jinek et al., Science 337:816-821 (2012); Cong et al., Science 339:819-823 (2013)). For the AKT2 sequence, there is a two-mismatch sequence differing at nucleotides 1 and 3, in the more "tolerant" half of the protospacer. Zero clones were obtained with mutations at this potential off-target site, as compared to 61% at the on-target site (Table S 1). For one of the SORT' sequences, use of a different human pluripotent stem cell line in which a single nucleotide polymorphism results in a one-nucleotide mismatch at the target site yielded mutant clones at an efficiency of 42%, compared to 66% in the original cell line. Thus, judicious selection of target sites is necessary to minimize systematic off-target effects; target sites with perfect-match or single-nucleotide-mismatch sequences elsewhere in the genome should be avoided.

From a practical standpoint, CRISPRs are easier to implement than TALENs. Each TALEN pair must be constructed do novo, whereas for CRISPRs the Cas9 component is fixed and the gRNA requires only swapping of the 20-nucleotide protospacer. Given this consideration and the demonstration herein of substantially increased efficiency as a result of replacing TALENs with CRISPRs in an otherwise identical system, CRISPRs appear to be a very powerful and broadly applicable tool for genome editing, particularly in a therapeutic context.

Example 2

Modified Cas9 mRNA Functions to Efficiently Introduce On-Target Mutations

Figure 19B:
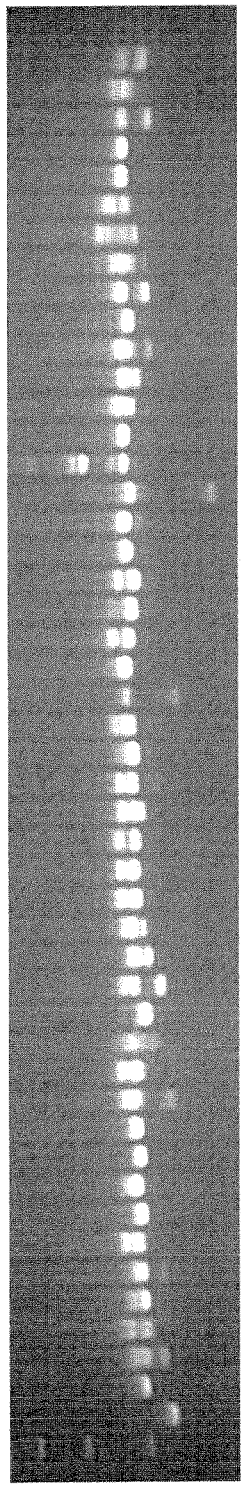

The inventors generated Figment (Fgm) knockout mice by CRIPSR/Cas9 gene editing utilizing a modified Cas9 mRNA. Fgm is a coding gene within the long non-coding RNA Lnc-Rap-5 (referred to herein as Fgm (Lnc-Rap-5; see Sun et al., "Long noncoding RNAs regulate adipogenesis," PNAS; 2013; 110(9):3387-3392, incorporated herein by reference in its entirety). The guide RNA (gRNA) sequence employed in this example was; 5' gaggcgaaagccactagcac 3'. The modified Cas9 mRNA used in this example was made using an in vitro transcription reaction in which pseudouridine and 5-methyl-cytosine were reacted with unmodified nucleotides and randomly integrated into the resulting modified Cas9 mRNA. An exemplary protocol for generating Fgm knockout mice using CRISPR/Cas9 gene editing utilizing a modified Cas9mRNA is shown in FIG. 19A. As shown in FIG. 19A, 100 ng/µl of the resulting modified Cas9 mRNA and 50 ng/µl of the guide RNA noted above targeting Fgm (Lnc-Rap-5) were injected into 250 C57BL/6 mouse zygotes that were subsequently transferred to pseudo-pregnant mice and after weening screened for mutations by PCR. As shown in the gel pictured in FIG. 19B, PCR screening revealed 63 mutant animals out of 65. These results indicate that modified Cas9 mRNA functions in vivo to efficiently (i.e., 97% efficiency) introduce on target mutations in mammals.

Example 3

Mutational Analysis of Genome Edited Hematopoietic Stem-Progenitor Cells (HSPCs) by Target Capture Deep Sequencing CRISPR/Cas9 has previously been shown to generate off-target mutations to varying degrees depending upon experimental setting and cell type (Cho et al., 2014; Cradick et al., 2013; Fu et al., 2013; Fu et al., 2014; Hruscha et al., 2013; Lin et al., 2014). To examine this in primary $CD34^+$ HSPCs we performed target capture sequencing, of $CD34^+$ HSPCs-mPB subjected to CRISPR/Cas9 CCR5-editing. Experimental design included capture of each gRNA target site (n=6) and predicted off-target sites (n=172) with expanded capture intervals of 500 base pairs flanking each site to ensure accurate detection of any genetic lesion occurring at or near the selected sites (FIGS. 17A and 20). We have previously shown that this approach can also capture structural variation breakpoints, such as translocations and inversions, in proximity to the capture site (Talkowski et al., 2011) (See supplemental text and methods for detailed description). Sorted $CD34^+$ HSPCs treated with Cas9 alone or in combination with multiple single gRNA (crCCR5_A, crCCR5_B, or crCCR5_C) or dual gRNA combinations (crCCR5_A+B, crCCR5_C+D, or crCCR5_D+Q) were sequenced to a mean target coverage of 3,390× across each 23 bp gRNA sequence and PAM (range 379.6×-7,969.5×)(FIG. 17B). Analysis of the resulting data revealed highly efficacious on-target mutagenesis with a diverse array of mutated sequence variants observed in both single-gRNA and dual-gRNA treatments (FIG. 17C). As expected we detected small InDels of up to 10 bp in addition to varying single nucleotide substitutions at the predicted target sites in the single-gRNA libraries. Strikingly, in each dual-gRNA library, no fewer than 15 alternate mutant alleles were observed at either one of the gRNA sites (FIGS. 21-23). Notably, the extreme sequencing depth of our analysis permitted estimation of mutation frequency for each particular variant, including mutations that were observed in only a few hundredths of a percent of the sample sequenced (FIG. 24). Predicted deletions (i.e. deletions spanning between the two gRNA target sites) were the most common mutations observed (crCCR5_A+B: 19.95%; crCCR5_C+D: 20.45%; crCCR5_D+Q: 42.13%), while small InDels (crCCR5_A+B: 3.06%; crCCR5_C+D: 0.50%; crCCR5_D+Q: 2.95%) were also frequent (FIG. 17C). Interestingly, for two dual gRNA combinations (crCCR5_A+B and crCCR5_D+Q) we also observed inversions between the two predicted Cas9 cleavage sites (crCCR5_A+B: 3.06%; crCCR5_D+Q: 2.48%). The most efficacious dual gRNA combination crCCR5_D+Q led to mutations in approximately 48% of the captured sequence reads (FIG. 17C).

We next examined the capture sequence reads at predicted off-target sites in the genome (FIG. 20). An N-fold enrichment analysis was performed, wherein we compared the total number of non-reference sequencing reads at each predicted off-target site in gRNA treated and control (Cas9 only) samples. This analysis generated a ratio where 1.0 indicates an equivalent number of non-reference sequence reads in both treated and control samples, values less than 1.0 indicate fewer non-reference reads in treated samples, and values greater than 1.0 indicate a greater number of non-reference reads in treated samples (see supplementary materials for additional details) (FIG. 17D). Strikingly, this analysis showed that the mean enrichment of mutations at off-target sites in all the gRNA-treated samples compared to control closely conformed to the null hypothesis (i.e., 0.99-fold enrichment compared to controls) indicating that off-target mutation events were extremely rare. Indeed, statistical evaluation of all captured off-target sites yielded a single site (1/172; 0.6%) in the sample treated with gRNA crCCR5_B alone that passed multiple test correction for a statistically significant enrichment for off-target InDels in the gRNA crCCR5 B treated libraries versus control ($p \leq 7.6 \times 10^{-11}$) (FIGS. 24-25). When we scrutinized the sequencing reads from the only statistically significant off-target site, which was located in the highly homologous CCR2 gene (FIG. 18A), we found that all sequence variants (36 out of 5,963 total reads) were one or two base InDels, (FIG. 18B). Of note, the other sample in which gRNA crCCR5_B was used (in combination with gRNA crCCR5_A) only 13 out of 5,339 reads supported mutation, however these events did not meet statistical significance above control or samples treated with other gRNAs (FIG. 18B, FIG. 24). Thus, off-target mutagenesis was exceedingly rare and moreover, the use of two gRNAs in combination did not increase the very low incidence of off-target mutagenesis. We also performed targeted analyses for structural variation at all sites and though we could easily detect on-target inversions in dual gRNA combination crCCR5_A+B and crCCR5_D+Q, there was no evidence for inversion or translocation at any off-target sites in any of the treatments. These data indicate that on-target mutagenesis efficiency was very high, and further that off-target mutagenesis was extremely infrequent for both single- and dual gRNA treatments.

Discussion

Our mutational analysis revealed highly efficacious mutagenesis of on-target sites in CD34 HSPCs. Single gRNAs generated a range of mutations with the vast majority comprised of small InDels. In contrast, dual gRNA combinations largely led to predicted deletions through a diverse array of mutations including InDels and even inversions were detected. Importantly, we only identified one statistically significant off-target site in the highly homologous CCR2 gene, which occurred in one out of 6 experimental settings (gRNA crCCR5_B alone). Sequence analysis of gRNA crCCR5_B in comparison to the identified off-target site in CCR2 indicated that it perfectly matched in the seed region and contained 3 sequence mismatches at the 5' end of the gRNA sequence (positions 1, 4 and 6). This data is consistent with previous studies showing that mismatches in the 5' proximal end of the gRNA are well tolerated by Cas9 (Lin et al., 2014; Wu et al., 2014). Our data therefore supports the idea that judicious guide design is critical for minimizing off-target mutations. Of note, our very deep sequencing analysis enabled detection of the sole off-target event we describe, whereas sequence analysis performed at lower sequencing depth—such as 50× coverage that has been used in previous off-target analyses (Smith et al., 2014; Suzuki et al., 2014; Veres et al., 2014)—would have been unable to detect this event. Overall, our analysis of CRISPR/Cas9 mutational activity in CD34+ HSPCs revealed very high on-target mutation rates and extremely low incidence of off-target mutagenesis.

Off-Target Prediction and Capture Sequencing

Degenerate gRNA off-target sequences were predicted for each gRNA targeting CCR5 using the CRISPR Design off-target prediction tool (Hsu et al., 2013). Off-target sequences were further supplemented by alignment of each gRNA to the human genome using BOWTIE of which all results up to and including 3 mismatches were added to the total off-target list (Langmead et al., 2009). All instances of each predicted off-target sequence existent in the human genome reference build GRCh37v71 were recorded (FIG. 20). Each guide RNA target site (n=6) and predicted off-target site (n=172) was selected for capture sequencing using the Agilent SureSelectXT Target Enrichment System. Capture intervals were expanded by approximately 500 bp in both the 5' and 3' directions to ensure exhaustive capture of the targeted region and detection of any genetic lesion occurring at or near a predicted gRNA on- or off-target site, as we have previously shown accurate capability to detect translocations and inversions using targeted capture of probes in proximity to a rearrangement breakpoint using a CapBP procedure as described (Talkowski et al., 2011). Probes were tiled with 60-fold greater density over each predicted 23 bp on- or off-target gRNA binding site than the flanking kilobase of sequence. Isogenic CD34+ HSPCs-mPB were transfected with CRISPR/Cas9 plasmids (one Cas9 only-treated control group, three treatment groups transfected with a single gRNA, and three treatment groups transfected with dual gRNAs). Sorted CD34+ genome edited HSPCs were cultured for two weeks prior to DNA isolation. Capture libraries were prepared from DNA extracted from seven treatment groups. Capture libraries were sequenced as 101 bp paired-end reads on an Illumina HiSeq2000 platform.

NGS Data Processing and Computational Analysis

Read pairs were aligned to GRCh37v71 with Bwa-MEM v0.7.10-r789 (Li, arXiv 2013). Alignments were processed using PicardTools and SAMBLASTER (Faust and Hall, 2014). The Genome Analysis Toolkit (GATK) v3.1-1-g07a4bf8 was applied for base quality score recalibration, insertion/deletion (InDel) realignment, duplicate removal, and single nucleotide variant (SNV) and InDel discovery and genotyping per published best-practice protocols (McKenna et al, Genome Res 2010; DePristo et al, Nat Genet 2011; Van der Auwera et al, 2013). SNVs and InDels were annotated using ANNOVAR (Wang et al., 2010). Structural variants (SVs) were detected with LUMPY v0.2.5 considering both anomalous pair and split read evidence at a minimum call weight threshold of 7 and an evidence set score ≤0.05 (Layer et al., 2014). Candidate copy number variants (CNVs) were further statistically assessed by Student's t-test for a concomitant change in depth of coverage across the putative CNV. As a final exhaustive measure, each on- and off-target site was manually scrutinized in each capture library for evidence supporting predictable mutagenesis that is not detectable by the computational algorithms due to low levels of mosaicism in the sequenced population.

Evaluation of Off-Target Mutation Frequency

A statistical framework was developed to assess off-target mutational burden for each gRNA. For each off-target site (n=172), all reads with at least one nucleotide of overlap with that 23 bp off-target site were collected and their CIGAR information was tabulated into categories as follows: reads representing small InDels (CIGAR contains at least one "I" or "D"), reads potentially representative of other rearrangements (CIGAR contains at least one "S" or "H"), and reads reflecting reference sequence (CIGAR did not match either of the two former categories). Such counts were gathered at all 172 sites in all seven libraries and were further pooled to form comparison groups of "treatment" libraries (transfected gRNA matches corresponding off-target site gRNA) and "control" libraries (transfected gRNA does not match corresponding off-target site gRNA). Next, at each off-target site, relative n-fold enrichment of each read classification between treatment and control libraries was evaluated. Finally, a one-tailed Fisher's Exact Test was performed to assess the statistical significance of enrichment of variant reads in treatments versus controls at each off-target site, followed by Bonferroni correction to retain an experiment-wide significance threshold of $\alpha=0.05$.

REFERENCES

1. Cong, L., et al., 2013. Multiplex genome engineering using CRISPR/Cas systems. Science. 339, 819-23.
2. Ding, Q., et al., 2013. Enhanced efficiency of human pluripotent stem cell genome editing through replacing TALENs with CRISPRs. Cell Stem Cell. 12, 393-4.
3. Jinek, M., et al., 2013. RNA-programmed genome editing in human cells. Elife. 2, e00471.
4. Li, D., et al., 2013. Heritable gene targeting in the mouse and rat using a CRISPR-Cas system. Nat Biotechnol. 31, 681-3.
5. Mali, P., et al., 2013. RNA-guided human genome engineering via Cas9. Science. 339, 823-6.
6. Niu, Y., et al., 2014. Generation of Gene-Modified Cynomolgus Monkey via Cas9/RNA-Mediated Gene Targeting in One-Cell Embryos. Cell. 156, 836-43.
7. Ran, F. A., et al., 2013. Double nicking by RNA-guided CRISPR Cas9 for enhanced genome editing specificity. Cell. 154, 1380-9.
8. Wang, H., et al., 2013. One-step generation of mice carrying mutations in multiple genes by CRISPR/Cas-mediated genome engineering. Cell. 153, 910-8.

SEQUENCE LISTING (5745 sequences)

SEQ ID NO: 1 - DNA, 23 bp, Artificial
  gRNA target site sequence
gcttctctgaaccaacgagcagg

SEQ ID NO: 2 - DNA, 23 bp, Artificial
  gRNA target site sequence
cttctctgaaccaacgagcaggg

SEQ ID NO: 3 - DNA, 23 bp, Artificial
  gRNA target site sequence
agaggttctgccctgctcgttgg

SEQ ID NO: 4 - DNA, 23 bp, Artificial
  gRNA target site sequence
tggaggagtggcgtcttcagagg

SEQ ID NO: 5 - DNA, 23 bp, Artificial
  gRNA target site sequence
gcctttccagaacatcaatgcgg

SEQ ID NO: 6 - DNA, 23 bp, Artificial
  gRNA target site sequence
tcctcccagaagatgaaaagagg

SEQ ID NO: 7 - DNA, 23 bp, Artificial
  gRNA target site sequence
cctcccagaagatgaaaagaggg

SEQ ID NO: 8 - DNA, 23 bp, Artificial
  gRNA target site sequence
gacctgctctataaagcctatgg

SEQ ID NO: 9 - DNA, 23 bp, Artificial
  gRNA target site sequence
acctgctctataaagcctatggg

SEQ ID NO: 10 - DNA, 23 bp, Artificial
  gRNA target site sequence
atgccaccttcagcctctgcagg

SEQ ID NO: 11 - DNA, 23 bp, Artificial
  gRNA target site sequence
caccttcagcctctgcaggtagg

SEQ ID NO: 12 - DNA, 23 bp, Artificial
  gRNA target site sequence
tctgcaggtaggttcctgtctgg

SEQ ID NO: 13 - DNA, 23 bp, Artificial
  gRNA target site sequence
ctgcaggtaggttcctgtctggg

SEQ ID NO: 14 - DNA, 23 bp, Artificial
  gRNA target site sequence
taggttcctgtctgggcttctgg

SEQ ID NO: 15 - DNA, 23 bp, Artificial
  gRNA target site sequence
aggttcctgtctgggcttctggg

SEQ ID NO: 16 - DNA, 23 bp, Artificial
  gRNA target site sequence
atgttctggaaaggccagaatgg

SEQ ID NO: 17 - DNA, 23 bp, Artificial
  gRNA target site sequence
gccgcattgatgttctggaaagg

SEQ ID NO: 18 - DNA, 23 bp, Artificial
  gRNA target site sequence
atttggccgcattgatgttctgg

SEQ ID NO: 19 - DNA, 23 bp, Artificial
  gRNA target site sequence
ttctgggaggaaactagatttgg

SEQ ID NO: 20 - DNA, 23 bp, Artificial
  gRNA target site sequence
ccctcttttcatcttctgggagg

SEQ ID NO: 21 - DNA, 23 bp, Artificial
  gRNA target site sequence
gctccctcttttcatcttctggg

SEQ ID NO: 22 - DNA, 23 bp, Artificial
  gRNA target site sequence
agctccctcttttcatcttctgg

SEQ ID NO: 23 - DNA, 23 bp, Artificial
  gRNA target site sequence
tcccataggctttatagagcagg

SEQ ID NO: 24 - DNA, 23 bp, Artificial
  gRNA target site sequence
ggctgaaggtggcatcccatagg

SEQ ID NO: 25 - DNA, 23 bp, Artificial
  gRNA target site sequence
ctacctgcagaggctgaaggtgg

SEQ ID NO: 26 - DNA, 23 bp, Artificial
  gRNA target site sequence
aacctacctgcagaggctgaagg

SEQ ID NO: 27 - DNA, 23 bp, Artificial
  gRNA target site sequence
agacaggaacctacctgcagagg

SEQ ID NO: 28 - DNA, 23 bp, Artificial
  gRNA target site sequence
tctcctcctccctcttctgcagg

SEQ ID NO: 29 - DNA, 23 bp, Artificial
  gRNA target site sequence
ctgcaggctcaaaaatgaccagg

SEQ ID NO: 30 - DNA, 23 bp, Artificial
  gRNA target site sequence
gctcatcttcaagtccaccctgg

SEQ ID NO: 31 - DNA, 23 bp, Artificial
  gRNA target site sequence
ctgattaccagatgaccaaacgg

SEQ ID NO: 32 - DNA, 23 bp, Artificial
  gRNA target site sequence
tgattaccagatgaccaaacggg

SEQ ID NO: 33 - DNA, 23 bp, Artificial
  gRNA target site sequence
ccagatgaccaaacgggacatgg

SEQ ID NO: 34 - DNA, 23 bp, Artificial
  gRNA target site sequence
cagatgaccaaacgggacatggg

SEQ ID NO: 35 - DNA, 23 bp, Artificial
  gRNA target site sequence
ggacatgggctttactgaagagg

SEQ ID NO: 36 - DNA, 23 bp, Artificial
  gRNA target site sequence
ttactgaagaggagtttaaaagg

SEQ ID NO: 37 - DNA, 23 bp, Artificial
  gRNA target site sequence
tgaagaggagtttaaaaggctgg

SEQ ID NO: 38 - DNA, 23 bp, Artificial
  gRNA target site sequence
gagtttaaaaggctggtgagtgg

SEQ ID NO: 39 - DNA, 23 bp, Artificial
  gRNA target site sequence
agtttaaaaggctggtgagtggg

SEQ ID NO: 40 - DNA, 23 bp, Artificial
  gRNA target site sequence
tgagtgggtgtgagccatactgg

SEQ ID NO: 41 - DNA, 23 bp, Artificial
  gRNA target site sequence
gagcctgcagaagagggaggagg

SEQ ID NO: 42 - DNA, 23 bp, Artificial
  gRNA target site sequence
tttgagcctgcagaagagggagg

SEQ ID NO: 43 - DNA, 23 bp, Artificial
  gRNA target site sequence
atttttgagcctgcagaagaggg

SEQ ID NO: 44 - DNA, 23 bp, Artificial
  gRNA target site sequence
catttttgagcctgcagaagagg

SEQ ID NO: 45 - DNA, 23 bp, Artificial
  gRNA target site sequence
tgttgagcgagtagttagcctgg

SEQ ID NO: 46 - DNA, 23 bp, Artificial
  gRNA target site sequence
gggtggacttgaagatgagcggg

SEQ ID NO: 47 - DNA, 23 bp, Artificial
  gRNA target site sequence
agggtggacttgaagatgagcgg

SEQ ID NO: 48 - DNA, 23 bp, Artificial
  gRNA target site sequence
ctggtaatcagtgtccagggtgg

SEQ ID NO: 49 - DNA, 23 bp, Artificial
  gRNA target site sequence
catctggtaatcagtgtccaggg

SEQ ID NO: 50 - DNA, 23 bp, Artificial
  gRNA target site sequence
tcatctggtaatcagtgtccagg

SEQ ID NO: 51 - DNA, 23 bp, Artificial
  gRNA target site sequence
ccatgtcccgtttggtcatctgg

SEQ ID NO: 52 - DNA, 23 bp, Artificial
  gRNA target site sequence
agtaaagcccatgtcccgtttgg

SEQ ID NO: 53 - DNA, 23 bp, Artificial
  gRNA target site sequence
tgctcttccagatctgcccctgg

SEQ ID NO: 54 - DNA, 23 bp, Artificial
  gRNA target site sequence
ccctggtccagctacctcactgg

SEQ ID NO: 55 - DNA, 23 bp, Artificial
  gRNA target site sequence
ccagctacctcactggtgcctgg

SEQ ID NO: 56 - DNA, 23 bp, Artificial
  gRNA target site sequence
cctcactggtgcctggaagccgg

SEQ ID NO: 57 - DNA, 23 bp, Artificial
  gRNA target site sequence
tggtgcctggaagccggacacgg

SEQ ID NO: 58 - DNA, 23 bp, Artificial
  gRNA target site sequence
acacggagcatgcagtcattcgg

SEQ ID NO: 59 - DNA, 23 bp, Artificial
  gRNA target site sequence
ttcggtgagctctgttcccctgg

SEQ ID NO: 60 - DNA, 23 bp, Artificial
  gRNA target site sequence
tcggtgagctctgttcccctggg

SEQ ID NO: 61 - DNA, 23 bp, Artificial
  gRNA target site sequence
tggaagagcaggtgtgtggctgg

SEQ ID NO: 62 - DNA, 23 bp, Artificial
  gRNA target site sequence
gatctggaagagcaggtgtgtgg

SEQ ID NO: 63 - DNA, 23 bp, Artificial
  gRNA target site sequence
aggggcagatctggaagagcagg

SEQ ID NO: 64 - DNA, 23 bp, Artificial
  gRNA target site sequence
agctggaccaggggcagatctgg

SEQ ID NO: 65 - DNA, 23 bp, Artificial
  gRNA target site sequence
cagtgaggtagctggaccagggg

SEQ ID NO: 66 - DNA, 23 bp, Artificial
  gRNA target site sequence
ccagtgaggtagctggaccaggg

SEQ ID NO: 67 - DNA, 23 bp, Artificial
  gRNA target site sequence
accagtgaggtagctggaccagg

SEQ ID NO: 68 - DNA, 23 bp, Artificial
  gRNA target site sequence
ccaggcaccagtgaggtagctgg

SEQ ID NO: 69 - DNA, 23 bp, Artificial
  gRNA target site sequence
ccggcttccaggcaccagtgagg

SEQ ID NO: 70 - DNA, 23 bp, Artificial
  gRNA target site sequence
atgctccgtgtccggcttccagg

SEQ ID NO: 71 - DNA, 23 bp, Artificial
  gRNA target site sequence
atgactgcatgctccgtgtccgg

SEQ ID NO: 72 - DNA, 23 bp, Artificial
  gRNA target site sequence
gctctattctgcttctctacagg

SEQ ID NO: 73 - DNA, 23 bp, Artificial
  gRNA target site sequence
ttctgcttctctacaggctgtgg

SEQ ID NO: 74 - DNA, 23 bp, Artificial
  gRNA target site sequence
tggacatactcaagacagagcgg

SEQ ID NO: 75 - DNA, 23 bp, Artificial
  gRNA target site sequence
catactcaagacagagcggctgg

SEQ ID NO: 76 - DNA, 23 bp, Artificial
  gRNA target site sequence
atactcaagacagagcggctggg

SEQ ID NO: 77 - DNA, 23 bp, Artificial
  gRNA target site sequence
aagacagagcggctgggacacgg

SEQ ID NO: 78 - DNA, 23 bp, Artificial
  gRNA target site sequence
gggacacggctaccacaccctgg

SEQ ID NO: 79 - DNA, 23 bp, Artificial
  gRNA target site sequence
ctaccacaccctggaagaccagg

SEQ ID NO: 80 - DNA, 23 bp, Artificial
  gRNA target site sequence
aagaccaggccctttataacagg

SEQ ID NO: 81 - DNA, 23 bp, Artificial
  gRNA target site sequence
aggccctttataacaggctgcgg

SEQ ID NO: 82 - DNA, 23 bp, Artificial
  gRNA target site sequence
cctttataacaggctgcggcagg

SEQ ID NO: 83 - DNA, 23 bp, Artificial
  gRNA target site sequence
gcaggaaaacatgcacttcgagg

SEQ ID NO: 84 - DNA, 23 bp, Artificial
  gRNA target site sequence
aacatgcacttcgaggtaagcgg

SEQ ID NO: 85 - DNA, 23 bp, Artificial
  gRNA target site sequence
acatgcacttcgaggtaagcggg

SEQ ID NO: 86 - DNA, 23 bp, Artificial
  gRNA target site sequence
cacttcgaggtaagcgggccagg

SEQ ID NO: 87 - DNA, 23 bp, Artificial
  gRNA target site sequence
acttcgaggtaagcgggccaggg

SEQ ID NO: 88 - DNA, 23 bp, Artificial
  gRNA target site sequence
gaggtaagcgggccagggagtgg

SEQ ID NO: 89 - DNA, 23 bp, Artificial
  gRNA target site sequence
aggtaagcgggccagggagtggg

SEQ ID NO: 90 - DNA, 23 bp, Artificial
  gRNA target site sequence
ggtaagcgggccagggagtgggg

SEQ ID NO: 91 - DNA, 23 bp, Artificial
  gRNA target site sequence
aagcgggccagggagtggggagg

SEQ ID NO: 92 - DNA, 23 bp, Artificial
  gRNA target site sequence
gggcctggtcttccagggtgtgg

SEQ ID NO: 93 - DNA, 23 bp, Artificial
  gRNA target site sequence
ataaagggcctggtcttccaggg

SEQ ID NO: 94 - DNA, 23 bp, Artificial
  gRNA target site sequence
tataaagggcctggtcttccagg

SEQ ID NO: 95 - DNA, 23 bp, Artificial
  gRNA target site sequence
gcagcctgttataaagggcctgg

SEQ ID NO: 96 - DNA, 23 bp, Artificial
  gRNA target site sequence
ctgccgcagcctgttataaaggg

SEQ ID NO: 97 - DNA, 23 bp, Artificial
  gRNA target site sequence
cctgccgcagcctgttataaagg

SEQ ID NO: 98 - DNA, 23 bp, Artificial
  gRNA target site sequence
gacctggctctcccccttccagg

SEQ ID NO: 99 - DNA, 23 bp, Artificial
  gRNA target site sequence
ctggctctcccccttccaggagg

SEQ ID NO: 100 - DNA, 23 bp, Artificial
  gRNA target site sequence
ttccaggaggctgtgaagagcgg

SEQ ID NO: 101 - DNA, 23 bp, Artificial
  gRNA target site sequence
attcaccgtactgtccacgccgg

SEQ ID NO: 102 - DNA, 23 bp, Artificial
  gRNA target site sequence
ttcaccgtactgtccacgccggg

SEQ ID NO: 103 - DNA, 23 bp, Artificial
  gRNA target site sequence
tcaccgtactgtccacgccgggg

SEQ ID NO: 104 - DNA, 23 bp, Artificial
  gRNA target site sequence
ccgtactgtccacgccggggagg

SEQ ID NO: 105 - DNA, 23 bp, Artificial
  gRNA target site sequence
tactgtccacgccggggaggtgg

SEQ ID NO: 106 - DNA, 23 bp, Artificial
  gRNA target site sequence
actgtccacgccggggaggtggg

SEQ ID NO: 107 - DNA, 23 bp, Artificial
  gRNA target site sequence
ccacgccggggaggtgggctcgg

SEQ ID NO: 108 - DNA, 23 bp, Artificial
  gRNA target site sequence
ctcggccgaagtagtaaaagagg

SEQ ID NO: 109 - DNA, 23 bp, Artificial
  gRNA target site sequence
ccgaagtagtaaaagaggtgagg

SEQ ID NO: 110 - DNA, 23 bp, Artificial
  gRNA target site sequence
cgaagtagtaaaagaggtgaggg

SEQ ID NO: 111 - DNA, 23 bp, Artificial
  gRNA target site sequence
tagtaaaagaggtgagggcctgg

SEQ ID NO: 112 - DNA, 23 bp, Artificial
  gRNA target site sequence
agtaaaagaggtgagggcctggg

SEQ ID NO: 113 - DNA, 23 bp, Artificial
  gRNA target site sequence
aaagaggtgagggcctgggctgg

SEQ ID NO: 114 - DNA, 23 bp, Artificial
  gRNA target site sequence
gtgagggcctgggctggccatgg

SEQ ID NO: 115 - DNA, 23 bp, Artificial
  gRNA target site sequence
tgagggcctgggctggccatggg

SEQ ID NO: 116 - DNA, 23 bp, Artificial
  gRNA target site sequence
gagggcctgggctggccatgggg

SEQ ID NO: 117 - DNA, 23 bp, Artificial
  gRNA target site sequence
ctcctggaagggggagagccagg

SEQ ID NO: 118 - DNA, 23 bp, Artificial
  gRNA target site sequence
cttcacagcctcctggaaggggg

SEQ ID NO: 119 - DNA, 23 bp, Artificial
  gRNA target site sequence
tcttcacagcctcctggaagggg

SEQ ID NO: 120 - DNA, 23 bp, Artificial
  gRNA target site sequence
ctcttcacagcctcctggaaggg

SEQ ID NO: 121 - DNA, 23 bp, Artificial
  gRNA target site sequence
gctcttcacagcctcctggaagg

SEQ ID NO: 122 - DNA, 23 bp, Artificial
  gRNA target site sequence
tgccgctcttcacagcctcctgg

SEQ ID NO: 123 - DNA, 23 bp, Artificial
  gRNA target site sequence
cctccccggcgtggacagtacgg

SEQ ID NO: 124 - DNA, 23 bp, Artificial
  gRNA target site sequence
ccgagcccacctccccggcgtgg

SEQ ID NO: 125 - DNA, 23 bp, Artificial
  gRNA target site sequence
ttcggccgagcccacctccccgg

SEQ ID NO: 126 - DNA, 23 bp, Artificial
  gRNA target site sequence
cctcacctcttttactacttcgg

SEQ ID NO: 127 - DNA, 23 bp, Artificial
  gRNA target site sequence
tgggcatctcgcccacagactgg

SEQ ID NO: 128 - DNA, 23 bp, Artificial
  gRNA target site sequence
gcccacagactggtcccccaagg

SEQ ID NO: 129 - DNA, 23 bp, Artificial
  gRNA target site sequence
cacagactggtcccccaaggtgg

SEQ ID NO: 130 - DNA, 23 bp, Artificial
  gRNA target site sequence
agactggtcccccaaggtggtgg

SEQ ID NO: 131 - DNA, 23 bp, Artificial
  gRNA target site sequence
gaagtaccagcagcagaccgtgg

SEQ ID NO: 132 - DNA, 23 bp, Artificial
  gRNA target site sequence
gaccgtggtagccattgacctgg

SEQ ID NO: 133 - DNA, 23 bp, Artificial
  gRNA target site sequence
gtggtagccattgacctggctgg

SEQ ID NO: 134 - DNA, 23 bp, Artificial
  gRNA target site sequence
gctggagatgagaccatcccagg

SEQ ID NO: 135 - DNA, 23 bp, Artificial
  gRNA target site sequence
ccaggaagcagcctcttgcctgg

SEQ ID NO: 136 - DNA, 23 bp, Artificial
  gRNA target site sequence
cctcttgcctggacatgtccagg

SEQ ID NO: 137 - DNA, 23 bp, Artificial
  gRNA target site sequence
tggacatgtccaggcctaccagg

SEQ ID NO: 138 - DNA, 23 bp, Artificial
  gRNA target site sequence
acatgtccaggcctaccaggtgg

SEQ ID NO: 139 - DNA, 23 bp, Artificial
  gRNA target site sequence
catgtccaggcctaccaggtggg

SEQ ID NO: 140 - DNA, 23 bp, Artificial
  gRNA target site sequence
accaggtgggtcctgtgagaagg

SEQ ID NO: 141 - DNA, 23 bp, Artificial
  gRNA target site sequence
gtgggtcctgtgagaaggaatgg

SEQ ID NO: 142 - DNA, 23 bp, Artificial
  gRNA target site sequence
tgtgggcgagatgcccacccagg

SEQ ID NO: 143 - DNA, 23 bp, Artificial
  gRNA target site sequence
accttgggggaccagtctgtggg

SEQ ID NO: 144 - DNA, 23 bp, Artificial
  gRNA target site sequence
caccttgggggaccagtctgtgg

SEQ ID NO: 145 - DNA, 23 bp, Artificial
  gRNA target site sequence
acacagctccaccaccttggggg

SEQ ID NO: 146 - DNA, 23 bp, Artificial
  gRNA target site sequence
tacacagctccaccaccttgggg

SEQ ID NO: 147 - DNA, 23 bp, Artificial
  gRNA target site sequence
ttacacagctccaccaccttggg

SEQ ID NO: 148 - DNA, 23 bp, Artificial
  gRNA target site sequence
cttacacagctccaccaccttgg

SEQ ID NO: 149 - DNA, 23 bp, Artificial
  gRNA target site sequence
tggctaccacggtctgctgctgg

SEQ ID NO: 150 - DNA, 23 bp, Artificial
  gRNA target site sequence
agccaggtcaatggctaccacgg

SEQ ID NO: 151 - DNA, 23 bp, Artificial
  gRNA target site sequence
ctcatctccagccaggtcaatgg

SEQ ID NO: 152 - DNA, 23 bp, Artificial
  gRNA target site sequence
ggatggtctcatctccagccagg

SEQ ID NO: 153 - DNA, 23 bp, Artificial
  gRNA target site sequence
caagaggctgcttcctgggatgg

SEQ ID NO: 154 - DNA, 23 bp, Artificial
  gRNA target site sequence
caggcaagaggctgcttcctggg

SEQ ID NO: 155 - DNA, 23 bp, Artificial
  gRNA target site sequence
ccaggcaagaggctgcttcctgg

SEQ ID NO: 156 - DNA, 23 bp, Artificial
  gRNA target site sequence
cctggacatgtccaggcaagagg

SEQ ID NO: 157 - DNA, 23 bp, Artificial
  gRNA target site sequence
tggtaggcctggacatgtccagg

SEQ ID NO: 158 - DNA, 23 bp, Artificial
  gRNA target site sequence
caggacccacctggtaggcctgg

SEQ ID NO: 159 - DNA, 23 bp, Artificial
  gRNA target site sequence
tctcacaggacccacctggtagg

SEQ ID NO: 160 - DNA, 23 bp, Artificial
  gRNA target site sequence
tccttctcacaggacccacctgg

SEQ ID NO: 161 - DNA, 23 bp, Artificial
  gRNA target site sequence
ctactcctctcctcacacagagg

SEQ ID NO: 162 - DNA, 23 bp, Artificial
  gRNA target site sequence
tactcctctcctcacacagaggg

SEQ ID NO: 163 - DNA, 23 bp, Artificial
  gRNA target site sequence
actcctctcctcacacagagggg

SEQ ID NO: 164 - DNA, 23 bp, Artificial
  gRNA target site sequence
aggggacctcaccccagacgagg

SEQ ID NO: 165 - DNA, 23 bp, Artificial
  gRNA target site sequence
ggacctcaccccagacgaggtgg

SEQ ID NO: 166 - DNA, 23 bp, Artificial
  gRNA target site sequence
cctcaccccagacgaggtggtgg

SEQ ID NO: 167 - DNA, 23 bp, Artificial
  gRNA target site sequence
agacgaggtggtggccctagtgg

SEQ ID NO: 168 - DNA, 23 bp, Artificial
  gRNA target site sequence
gacgaggtggtggccctagtggg

SEQ ID NO: 169 - DNA, 23 bp, Artificial
  gRNA target site sequence
ggtggtggccctagtgggccagg

SEQ ID NO: 170 - DNA, 23 bp, Artificial
  gRNA target site sequence
gtggtggccctagtgggccaggg

SEQ ID NO: 171 - DNA, 23 bp, Artificial
  gRNA target site sequence
cctagtgggccagggcctgcagg

SEQ ID NO: 172 - DNA, 23 bp, Artificial
  gRNA target site sequence
agtgggccagggcctgcaggagg

SEQ ID NO: 173 - DNA, 23 bp, Artificial
  gRNA target site sequence
gtgggccagggcctgcaggaggg

SEQ ID NO: 174 - DNA, 23 bp, Artificial
  gRNA target site sequence
tgggccagggcctgcaggagggg

SEQ ID NO: 175 - DNA, 23 bp, Artificial
  gRNA target site sequence
gggccagggcctgcaggaggggg

SEQ ID NO: 176 - DNA, 23 bp, Artificial
  gRNA target site sequence
caggagggggagcgagacttcgg

SEQ ID NO: 177 - DNA, 23 bp, Artificial
  gRNA target site sequence
aggagggggagcgagacttcggg

SEQ ID NO: 178 - DNA, 23 bp, Artificial
  gRNA target site sequence
ggagggggagcgagacttcgggg

SEQ ID NO: 179 - DNA, 23 bp, Artificial
  gRNA target site sequence
ggagcgagacttcggggtcaagg

SEQ ID NO: 180 - DNA, 23 bp, Artificial
  gRNA target site sequence
gagacttcggggtcaaggcccgg

SEQ ID NO: 181 - DNA, 23 bp, Artificial
  gRNA target site sequence
gcgccaccagcccagtgagtagg

SEQ ID NO: 182 - DNA, 23 bp, Artificial
  gRNA target site sequence
tctgtgtgaggagaggagtaggg

SEQ ID NO: 183 - DNA, 23 bp, Artificial
  gRNA target site sequence
ctctgtgtgaggagaggagtagg

SEQ ID NO: 184 - DNA, 23 bp, Artificial
  gRNA target site sequence
ggtcccctctgtgtgaggagagg

SEQ ID NO: 185 - DNA, 23 bp, Artificial
  gRNA target site sequence
ggtgaggtcccctctgtgtgagg

SEQ ID NO: 186 - DNA, 23 bp, Artificial
  gRNA target site sequence
ccaccacctcgtctggggtgagg

SEQ ID NO: 187 - DNA, 23 bp, Artificial
  gRNA target site sequence
tagggccaccacctcgtctgggg

SEQ ID NO: 188 - DNA, 23 bp, Artificial
  gRNA target site sequence
ctagggccaccacctcgtctggg

SEQ ID NO: 189 - DNA, 23 bp, Artificial
  gRNA target site sequence
actagggccaccacctcgtctgg

SEQ ID NO: 190 - DNA, 23 bp, Artificial
  gRNA target site sequence
ctgcaggccctggcccactaggg

SEQ ID NO: 191 - DNA, 23 bp, Artificial
  gRNA target site sequence
cctgcaggccctggcccactagg

SEQ ID NO: 192 - DNA, 23 bp, Artificial
  gRNA target site sequence
gctccccctcctgcaggccctgg

SEQ ID NO: 193 - DNA, 23 bp, Artificial
  gRNA target site sequence
agtctcgctccccctcctgcagg

SEQ ID NO: 194 - DNA, 23 bp, Artificial
  gRNA target site sequence
catgcagcacaggatggaccggg

SEQ ID NO: 195 - DNA, 23 bp, Artificial
  gRNA target site sequence
gcatgcagcacaggatggaccgg

SEQ ID NO: 196 - DNA, 23 bp, Artificial
  gRNA target site sequence
gtggcgcatgcagcacaggatgg

SEQ ID NO: 197 - DNA, 23 bp, Artificial
  gRNA target site sequence
gctggtggcgcatgcagcacagg

SEQ ID NO: 198 - DNA, 23 bp, Artificial
  gRNA target site sequence
gatcctactcactgggctggtgg

SEQ ID NO: 199 - DNA, 23 bp, Artificial
  gRNA target site sequence
ggtgatcctactcactgggctgg

SEQ ID NO: 200 - DNA, 23 bp, Artificial
  gRNA target site sequence
gggcggtgatcctactcactggg

SEQ ID NO: 201 - DNA, 23 bp, Artificial
  gRNA target site sequence
agggcggtgatcctactcactgg

SEQ ID NO: 202 - DNA, 23 bp, Artificial
  gRNA target site sequence
aacccctttcttcccttcccagg

SEQ ID NO: 203 - DNA, 23 bp, Artificial
  gRNA target site sequence
acccctttcttcccttcccaggg

SEQ ID NO: 204 - DNA, 23 bp, Artificial
  gRNA target site sequence
cccctttcttcccttcccagggg

SEQ ID NO: 205 - DNA, 23 bp, Artificial
  gRNA target site sequence
cttcccttcccaggggctgccgg

SEQ ID NO: 206 - DNA, 23 bp, Artificial
  gRNA target site sequence
ttcccttcccaggggctgccggg

SEQ ID NO: 207 - DNA, 23 bp, Artificial
  gRNA target site sequence
ccttcccaggggctgccgggagg

SEQ ID NO: 208 - DNA, 23 bp, Artificial
  gRNA target site sequence
gctgccgggaggctatcaaaagg

SEQ ID NO: 209 - DNA, 23 bp, Artificial
  gRNA target site sequence
ctatgagtttgtagagatgaagg

SEQ ID NO: 210 - DNA, 23 bp, Artificial
  gRNA target site sequence
tgtagagatgaaggccaaagagg

SEQ ID NO: 211 - DNA, 23 bp, Artificial
  gRNA target site sequence
gtagagatgaaggccaaagaggg

SEQ ID NO: 212 - DNA, 23 bp, Artificial
  gRNA target site sequence
gatgaaggccaaagagggcgtgg

SEQ ID NO: 213 - DNA, 23 bp, Artificial
  gRNA target site sequence
caaagagggcgtggtgtatgtgg

SEQ ID NO: 214 - DNA, 23 bp, Artificial
  gRNA target site sequence
agagggcgtggtgtatgtggagg

SEQ ID NO: 215 - DNA, 23 bp, Artificial
  gRNA target site sequence
gcgtggtgtatgtggaggtgcgg

SEQ ID NO: 216 - DNA, 23 bp, Artificial
  gRNA target site sequence
gcggtacagtccgcacctgctgg

SEQ ID NO: 217 - DNA, 23 bp, Artificial
  gRNA target site sequence
cctgctggccaactccaaagtgg

SEQ ID NO: 218 - DNA, 23 bp, Artificial
  gRNA target site sequence
ccaaagtggagccaatcccctgg

SEQ ID NO: 219 - DNA, 23 bp, Artificial
  gRNA target site sequence
ggagccaatcccctggaaccagg

SEQ ID NO: 220 - DNA, 23 bp, Artificial
  gRNA target site sequence
gaaccaggctgagtgagtgatgg

SEQ ID NO: 221 - DNA, 23 bp, Artificial
  gRNA target site sequence
aaccaggctgagtgagtgatggg

SEQ ID NO: 222 - DNA, 23 bp, Artificial
  gRNA target site sequence
ggctgagtgagtgatgggcctgg

SEQ ID NO: 223 - DNA, 23 bp, Artificial
  gRNA target site sequence
gagtgagtgatgggcctggaagg

SEQ ID NO: 224 - DNA, 23 bp, Artificial
  gRNA target site sequence
agtgagtgatgggcctggaaggg

SEQ ID NO: 225 - DNA, 23 bp, Artificial
  gRNA target site sequence
gtgagtgatgggcctggaagggg

SEQ ID NO: 226 - DNA, 23 bp, Artificial
  gRNA target site sequence
gggaagggaagaaaggggttggg

SEQ ID NO: 227 - DNA, 23 bp, Artificial
  gRNA target site sequence
tgggaagggaagaaaggggttgg

SEQ ID NO: 228 - DNA, 23 bp, Artificial
  gRNA target site sequence
cccctgggaagggaagaaagggg

SEQ ID NO: 229 - DNA, 23 bp, Artificial
  gRNA target site sequence
gcccctgggaagggaagaaaggg

SEQ ID NO: 230 - DNA, 23 bp, Artificial
  gRNA target site sequence
agcccctgggaagggaagaaagg

SEQ ID NO: 231 - DNA, 23 bp, Artificial
  gRNA target site sequence
ctcccggcagcccctgggaaggg

SEQ ID NO: 232 - DNA, 23 bp, Artificial
  gRNA target site sequence
cctcccggcagcccctgggaagg

SEQ ID NO: 233 - DNA, 23 bp, Artificial
  gRNA target site sequence
atagcctcccggcagcccctggg

SEQ ID NO: 234 - DNA, 23 bp, Artificial
  gRNA target site sequence
gatagcctcccggcagcccctgg

SEQ ID NO: 235 - DNA, 23 bp, Artificial
  gRNA target site sequence
cgatccttttgatagcctcccgg

SEQ ID NO: 236 - DNA, 23 bp, Artificial
  gRNA target site sequence
cttcatctctacaaactcatagg

SEQ ID NO: 237 - DNA, 23 bp, Artificial
  gRNA target site sequence
cacatacaccacgccctctttgg

SEQ ID NO: 238 - DNA, 23 bp, Artificial
  gRNA target site sequence
ttggagttggccagcaggtgcgg

SEQ ID NO: 239 - DNA, 23 bp, Artificial
  gRNA target site sequence
ccactttggagttggccagcagg

SEQ ID NO: 240 - DNA, 23 bp, Artificial
  gRNA target site sequence
gattggctccactttggagttgg

SEQ ID NO: 241 - DNA, 23 bp, Artificial
  gRNA target site sequence
ccaggggattggctccactttgg

SEQ ID NO: 242 - DNA, 23 bp, Artificial
  gRNA target site sequence
tcagcctggttccaggggattgg

SEQ ID NO: 243 - DNA, 23 bp, Artificial
  gRNA target site sequence
ctcactcagcctggttccagggg

SEQ ID NO: 244 - DNA, 23 bp, Artificial
  gRNA target site sequence
actcactcagcctggttccaggg

SEQ ID NO: 245 - DNA, 23 bp, Artificial
  gRNA target site sequence
cactcactcagcctggttccagg

SEQ ID NO: 246 - DNA, 23 bp, Artificial
  gRNA target site sequence
ggcccatcactcactcagcctgg

SEQ ID NO: 247 - DNA, 23 bp, Artificial
  gRNA target site sequence
ccactcactgttttgtttccagg

SEQ ID NO: 248 - DNA, 23 bp, Artificial
  gRNA target site sequence
ctcactgttttgtttccaggagg

SEQ ID NO: 249 - DNA, 23 bp, Artificial
  gRNA target site sequence
tgttttgtttccaggaggagagg

SEQ ID NO: 250 - DNA, 23 bp, Artificial
  gRNA target site sequence
gttttgtttccaggaggagaggg

SEQ ID NO: 251 - DNA, 23 bp, Artificial
  gRNA target site sequence
cctcccagctaacacagcagagg

SEQ ID NO: 252 - DNA, 23 bp, Artificial
  gRNA target site sequence
ctcccagctaacacagcagaggg

SEQ ID NO: 253 - DNA, 23 bp, Artificial
  gRNA target site sequence
tcccagctaacacagcagagggg

SEQ ID NO: 254 - DNA, 23 bp, Artificial
  gRNA target site sequence
gaggggctgctgaacgtcattgg

SEQ ID NO: 255 - DNA, 23 bp, Artificial
  gRNA target site sequence
gctgctgaacgtcattggcatgg

SEQ ID NO: 256 - DNA, 23 bp, Artificial
  gRNA target site sequence
gctcacccttccagacttcctgg

SEQ ID NO: 257 - DNA, 23 bp, Artificial
  gRNA target site sequence
gtgagttgcccccaacccacagg

SEQ ID NO: 258 - DNA, 23 bp, Artificial
  gRNA target site sequence
ggaaacaaaacagtgagtggtgg

SEQ ID NO: 259 - DNA, 23 bp, Artificial
  gRNA target site sequence
cctggaaacaaaacagtgagtgg

SEQ ID NO: 260 - DNA, 23 bp, Artificial
  gRNA target site sequence
gagggcgatccctctcctcctgg

SEQ ID NO: 261 - DNA, 23 bp, Artificial
  gRNA target site sequence
ctctgctgtgttagctgggaggg

SEQ ID NO: 262 - DNA, 23 bp, Artificial
  gRNA target site sequence
cctctgctgtgttagctgggagg

SEQ ID NO: 263 - DNA, 23 bp, Artificial
  gRNA target site sequence
gcccctctgctgtgttagctggg

SEQ ID NO: 264 - DNA, 23 bp, Artificial
  gRNA target site sequence
agcccctctgctgtgttagctgg

SEQ ID NO: 265 - DNA, 23 bp, Artificial
  gRNA target site sequence
aggaagtctggaagggtgagcgg

SEQ ID NO: 266 - DNA, 23 bp, Artificial
  gRNA target site sequence
cttggccaggaagtctggaaggg

SEQ ID NO: 267 - DNA, 23 bp, Artificial
  gRNA target site sequence
acttggccaggaagtctggaagg

SEQ ID NO: 268 - DNA, 23 bp, Artificial
  gRNA target site sequence
tcaaacttggccaggaagtctgg

SEQ ID NO: 269 - DNA, 23 bp, Artificial
  gRNA target site sequence
tgtagtagtcaaacttggccagg

SEQ ID NO: 270 - DNA, 23 bp, Artificial
  gRNA target site sequence
aggcatgtagtagtcaaacttgg

SEQ ID NO: 271 - DNA, 23 bp, Artificial
  gRNA target site sequence
ggggcaactcacgcgatagcagg

SEQ ID NO: 272 - DNA, 23 bp, Artificial
  gRNA target site sequence
tcttccccctgcccccttgcagg

SEQ ID NO: 273 - DNA, 23 bp, Artificial
  gRNA target site sequence
tccccctgcccccttgcaggtgg

SEQ ID NO: 274 - DNA, 23 bp, Artificial
  gRNA target site sequence
gaactgcatgtccacctagacgg

SEQ ID NO: 275 - DNA, 23 bp, Artificial
  gRNA target site sequence
cctgaaaccatcttatactatgg

SEQ ID NO: 276 - DNA, 23 bp, Artificial
  gRNA target site sequence
aaaccatcttatactatggcagg

SEQ ID NO: 277 - DNA, 23 bp, Artificial
  gRNA target site sequence
tccacctgcaagggggcaggggg

SEQ ID NO: 278 - DNA, 23 bp, Artificial
  gRNA target site sequence
ttccacctgcaagggggcagggg

SEQ ID NO: 279 - DNA, 23 bp, Artificial
  gRNA target site sequence
gttccacctgcaagggggcaggg

SEQ ID NO: 280 - DNA, 23 bp, Artificial
  gRNA target site sequence
agttccacctgcaagggggcagg

SEQ ID NO: 281 - DNA, 23 bp, Artificial
  gRNA target site sequence
atgcagttccacctgcaaggggg

SEQ ID NO: 282 - DNA, 23 bp, Artificial
  gRNA target site sequence
catgcagttccacctgcaagggg

SEQ ID NO: 283 - DNA, 23 bp, Artificial
  gRNA target site sequence
acatgcagttccacctgcaaggg

SEQ ID NO: 284 - DNA, 23 bp, Artificial
  gRNA target site sequence
gacatgcagttccacctgcaagg

SEQ ID NO: 285 - DNA, 23 bp, Artificial
  gRNA target site sequence
gcttgatggatccgtctaggtgg

SEQ ID NO: 286 - DNA, 23 bp, Artificial
  gRNA target site sequence
caggcttgatggatccgtctagg

SEQ ID NO: 287 - DNA, 23 bp, Artificial
  gRNA target site sequence
taagatggtttcaggcttgatgg

SEQ ID NO: 288 - DNA, 23 bp, Artificial
  gRNA target site sequence
ccatagtataagatggtttcagg

SEQ ID NO: 289 - DNA, 23 bp, Artificial
  gRNA target site sequence
ttacctgccatagtataagatgg

SEQ ID NO: 290 - DNA, 23 bp, Artificial
  gRNA target site sequence
cggggcgcacgagggcaccatgg

SEQ ID NO: 291 - DNA, 23 bp, Artificial
  gRNA target site sequence
aagcccaaagtgagcgcgcgcgg

SEQ ID NO: 292 - DNA, 23 bp, Artificial
  gRNA target site sequence
agcccaaagtgagcgcgcgcggg

SEQ ID NO: 293 - DNA, 23 bp, Artificial
  gRNA target site sequence
gcccaaagtgagcgcgcgcgggg

SEQ ID NO: 294 - DNA, 23 bp, Artificial
  gRNA target site sequence
cccaaagtgagcgcgcgcggggg

SEQ ID NO: 295 - DNA, 23 bp, Artificial
  gRNA target site sequence
gtgagcgcgcgcgggggctccgg

SEQ ID NO: 296 - DNA, 23 bp, Artificial
  gRNA target site sequence
tgagcgcgcgcgggggctccggg

SEQ ID NO: 297 - DNA, 23 bp, Artificial
  gRNA target site sequence
gagcgcgcgcgggggctccgggg

SEQ ID NO: 298 - DNA, 23 bp, Artificial
  gRNA target site sequence
catggtgccctcgtgcgccccgg

SEQ ID NO: 299 - DNA, 23 bp, Artificial
  gRNA target site sequence
gaaggcgggcgtctgggccatgg

SEQ ID NO: 300 - DNA, 23 bp, Artificial
  gRNA target site sequence
cttgtcgaaggcgggcgtctggg

SEQ ID NO: 301 - DNA, 23 bp, Artificial
  gRNA target site sequence
gcttgtcgaaggcgggcgtctgg

SEQ ID NO: 302 - DNA, 23 bp, Artificial
  gRNA target site sequence
actttgggcttgtcgaaggcggg

SEQ ID NO: 303 - DNA, 23 bp, Artificial
  gRNA target site sequence
cactttgggcttgtcgaaggcgg

SEQ ID NO: 304 - DNA, 23 bp, Artificial
  gRNA target site sequence
gctcactttgggcttgtcgaagg

SEQ ID NO: 305 - DNA, 23 bp, Artificial
  gRNA target site sequence
cccccgcgcgcgctcactttggg

SEQ ID NO: 306 - DNA, 23 bp, Artificial
  gRNA target site sequence
gcccccgcgcgcgctcactttgg

SEQ ID NO: 307 - DNA, 23 bp, Artificial
  gRNA target site sequence
tatttcagcctagtatcagaagg

SEQ ID NO: 308 - DNA, 23 bp, Artificial
  gRNA target site sequence
cagcctagtatcagaaggccagg

SEQ ID NO: 309 - DNA, 23 bp, Artificial
  gRNA target site sequence
gatactaggctgaaatagagagg

SEQ ID NO: 310 - DNA, 23 bp, Artificial
  gRNA target site sequence
tcgcctggccttctgatactagg

SEQ ID NO: 311 - DNA, 23 bp, Artificial
  gRNA target site sequence
tcttcctgttctcagatcaccgg

SEQ ID NO: 312 - DNA, 23 bp, Artificial
  gRNA target site sequence
cttcctgttctcagatcaccggg

SEQ ID NO: 313 - DNA, 23 bp, Artificial
  gRNA target site sequence
ttcctgttctcagatcaccgggg

SEQ ID NO: 314 - DNA, 23 bp, Artificial
  gRNA target site sequence
tcgatcagatgataatgaaaagg

SEQ ID NO: 315 - DNA, 23 bp, Artificial
  gRNA target site sequence
ccccactcatagagtactacagg

SEQ ID NO: 316 - DNA, 23 bp, Artificial
  gRNA target site sequence
tcatagagtactacaggaaacgg

SEQ ID NO: 317 - DNA, 23 bp, Artificial
  gRNA target site sequence
catagagtactacaggaaacggg

SEQ ID NO: 318 - DNA, 23 bp, Artificial
  gRNA target site sequence
atagagtactacaggaaacgggg

SEQ ID NO: 319 - DNA, 23 bp, Artificial
  gRNA target site sequence
tagagtactacaggaaacggggg

SEQ ID NO: 320 - DNA, 23 bp, Artificial
  gRNA target site sequence
caaagccacatgtaaagacttgg

SEQ ID NO: 321 - DNA, 23 bp, Artificial
  gRNA target site sequence
ttccccggtgatctgagaacagg

SEQ ID NO: 322 - DNA, 23 bp, Artificial
  gRNA target site sequence
tcgacggatcaagggttccccgg

SEQ ID NO: 323 - DNA, 23 bp, Artificial
  gRNA target site sequence
tcatctgatcgacggatcaaggg

SEQ ID NO: 324 - DNA, 23 bp, Artificial
  gRNA target site sequence
atcatctgatcgacggatcaagg

SEQ ID NO: 325 - DNA, 23 bp, Artificial
  gRNA target site sequence
tttcattatcatctgatcgacgg

SEQ ID NO: 326 - DNA, 23 bp, Artificial
  gRNA target site sequence
ggcttgcaggcggattttcaagg

SEQ ID NO: 327 - DNA, 23 bp, Artificial
  gRNA target site sequence
gagtgtggtaggcttgcaggcgg

SEQ ID NO: 328 - DNA, 23 bp, Artificial
  gRNA target site sequence
tttgagtgtggtaggcttgcagg

SEQ ID NO: 329 - DNA, 23 bp, Artificial
  gRNA target site sequence
tggggtggtttgagtgtggtagg

SEQ ID NO: 330 - DNA, 23 bp, Artificial
  gRNA target site sequence
tgagtggggtggtttgagtgtgg

SEQ ID NO: 331 - DNA, 23 bp, Artificial
  gRNA target site sequence
gtagtactctatgagtggggtgg

SEQ ID NO: 332 - DNA, 23 bp, Artificial
  gRNA target site sequence
cctgtagtactctatgagtgggg

SEQ ID NO: 333 - DNA, 23 bp, Artificial
  gRNA target site sequence
tcctgtagtactctatgagtggg

SEQ ID NO: 334 - DNA, 23 bp, Artificial
  gRNA target site sequence
ttcctgtagtactctatgagtgg

SEQ ID NO: 335 - DNA, 23 bp, Artificial
  gRNA target site sequence
gggatgcatcgatggcggagtgg

SEQ ID NO: 336 - DNA, 23 bp, Artificial
  gRNA target site sequence
ggtctgggatgcatcgatggcgg

SEQ ID NO: 337 - DNA, 23 bp, Artificial
  gRNA target site sequence
gggggtctgggatgcatcgatgg

SEQ ID NO: 338 - DNA, 23 bp, Artificial
  gRNA target site sequence
gaacacgacatcgggggtctggg

SEQ ID NO: 339 - DNA, 23 bp, Artificial
  gRNA target site sequence
cgaacacgacatcgggggtctgg

SEQ ID NO: 340 - DNA, 23 bp, Artificial
  gRNA target site sequence
gcttgcgaacacgacatcggggg

SEQ ID NO: 341 - DNA, 23 bp, Artificial
  gRNA target site sequence
tgcttgcgaacacgacatcgggg

SEQ ID NO: 342 - DNA, 23 bp, Artificial
  gRNA target site sequence
atgcttgcgaacacgacatcggg

SEQ ID NO: 343 - DNA, 23 bp, Artificial
  gRNA target site sequence
gatgcttgcgaacacgacatcgg

SEQ ID NO: 344 - DNA, 23 bp, Artificial
  gRNA target site sequence
tggctttggagaaggctgctagg

SEQ ID NO: 345 - DNA, 23 bp, Artificial
  gRNA target site sequence
tttacatgtggctttggagaagg

SEQ ID NO: 346 - DNA, 23 bp, Artificial
  gRNA target site sequence
caagtctttacatgtggctttgg

SEQ ID NO: 347 - DNA, 23 bp, Artificial
  gRNA target site sequence
cataaccaagtctttacatgtgg

SEQ ID NO: 348 - DNA, 23 bp, Artificial
  gRNA target site sequence
atattcatttgctgtctttcagg

SEQ ID NO: 349 - DNA, 23 bp, Artificial
  gRNA target site sequence
aggctgattcaccccaagagtgg

SEQ ID NO: 350 - DNA, 23 bp, Artificial
  gRNA target site sequence
gagtggccgttcctaccacgagg

SEQ ID NO: 351 - DNA, 23 bp, Artificial
  gRNA target site sequence
aagatgacgtatgtaaactcagg

SEQ ID NO: 352 - DNA, 23 bp, Artificial
  gRNA target site sequence
ggtaggaacggccactcttgggg

SEQ ID NO: 353 - DNA, 23 bp, Artificial
  gRNA target site sequence
tggtaggaacggccactcttggg

SEQ ID NO: 354 - DNA, 23 bp, Artificial
  gRNA target site sequence
gtggtaggaacggccactcttgg

SEQ ID NO: 355 - DNA, 23 bp, Artificial
  gRNA target site sequence
tgaactcctcgtggtaggaacgg

SEQ ID NO: 356 - DNA, 23 bp, Artificial
  gRNA target site sequence
agggttgaactcctcgtggtagg

SEQ ID NO: 357 - DNA, 23 bp, Artificial
  gRNA target site sequence
ttggagggttgaactcctcgtgg

SEQ ID NO: 358 - DNA, 23 bp, Artificial
  gRNA target site sequence
ctttcatgggctcttttggaggg

SEQ ID NO: 359 - DNA, 23 bp, Artificial
  gRNA target site sequence
tctttcatgggctcttttggagg

SEQ ID NO: 360 - DNA, 23 bp, Artificial
  gRNA target site sequence
tcatctttcatgggctcttttgg

SEQ ID NO: 361 - DNA, 23 bp, Artificial
  gRNA target site sequence
ttacatacgtcatctttcatggg

SEQ ID NO: 362 - DNA, 23 bp, Artificial
  gRNA target site sequence
tttacatacgtcatctttcatgg

SEQ ID NO: 363 - DNA, 23 bp, Artificial
  gRNA target site sequence
tttacagctcgatgacctcatgg

SEQ ID NO: 364 - DNA, 23 bp, Artificial
  gRNA target site sequence
tcgatgacctcatggagaagagg

SEQ ID NO: 365 - DNA, 23 bp, Artificial
  gRNA target site sequence
ctgctgatccgaagaatcacagg

SEQ ID NO: 366 - DNA, 23 bp, Artificial
  gRNA target site sequence
tgatccgaagaatcacaggaagg

SEQ ID NO: 367 - DNA, 23 bp, Artificial
  gRNA target site sequence
ggaaggtatttgtcccttgaagg

SEQ ID NO: 368 - DNA, 23 bp, Artificial
  gRNA target site sequence
tcgagctgtaaaagaatgtgtgg

SEQ ID NO: 369 - DNA, 23 bp, Artificial
  gRNA target site sequence
tctctttcctcttctccatgagg

SEQ ID NO: 370 - DNA, 23 bp, Artificial
  gRNA target site sequence
ttcggatcagcagagagtctggg

SEQ ID NO: 371 - DNA, 23 bp, Artificial
  gRNA target site sequence
cttcggatcagcagagagtctgg

SEQ ID NO: 372 - DNA, 23 bp, Artificial
  gRNA target site sequence
aataccttcctgtgattcttcgg

SEQ ID NO: 373 - DNA, 23 bp, Artificial
  gRNA target site sequence
ctattttgttcctaacttccagg

SEQ ID NO: 374 - DNA, 23 bp, Artificial
  gRNA target site sequence
cttccaggtgagtgatgaaatgg

SEQ ID NO: 375 - DNA, 23 bp, Artificial
  gRNA target site sequence
ggtgagtgatgaaatggtagtgg

SEQ ID NO: 376 - DNA, 23 bp, Artificial
  gRNA target site sequence
ggagctcattgagaagaatttgg

SEQ ID NO: 377 - DNA, 23 bp, Artificial
  gRNA target site sequence
gagacccccttgtgcaaaaatgg

SEQ ID NO: 378 - DNA, 23 bp, Artificial
  gRNA target site sequence
gtgcaaaaatggttttcttctgg

SEQ ID NO: 379 - DNA, 23 bp, Artificial
  gRNA target site sequence
aaaaatggttttcttctggatgg

SEQ ID NO: 380 - DNA, 23 bp, Artificial
  gRNA target site sequence
ttcttctggatggcttccctcgg

SEQ ID NO: 381 - DNA, 23 bp, Artificial
  gRNA target site sequence
atggcttccctcggactgtgagg

SEQ ID NO: 382 - DNA, 23 bp, Artificial
  gRNA target site sequence
cttccctcggactgtgaggcagg

SEQ ID NO: 383 - DNA, 23 bp, Artificial
  gRNA target site sequence
gactgtgaggcaggcagaaatgg

SEQ ID NO: 384 - DNA, 23 bp, Artificial
  gRNA target site sequence
tgtgaggcaggcagaaatggtgg

SEQ ID NO: 385 - DNA, 23 bp, Artificial
  gRNA target site sequence
gtgaggcaggcagaaatggtggg

SEQ ID NO: 386 - DNA, 23 bp, Artificial
  gRNA target site sequence
tcatcactcacctggaagttagg

SEQ ID NO: 387 - DNA, 23 bp, Artificial
  gRNA target site sequence
ctaccatttcatcactcacctgg

SEQ ID NO: 388 - DNA, 23 bp, Artificial
  gRNA target site sequence
aaaaccatttttgcacaaggggg

SEQ ID NO: 389 - DNA, 23 bp, Artificial
  gRNA target site sequence
gaaaaccatttttgcacaagggg

SEQ ID NO: 390 - DNA, 23 bp, Artificial
  gRNA target site sequence
agaaaaccatttttgcacaaggg

SEQ ID NO: 391 - DNA, 23 bp, Artificial
  gRNA target site sequence
aagaaaaccatttttgcacaagg

SEQ ID NO: 392 - DNA, 23 bp, Artificial
  gRNA target site sequence
ctgcctgcctcacagtccgaggg

SEQ ID NO: 393 - DNA, 23 bp, Artificial
  gRNA target site sequence
tctgcctgcctcacagtccgagg

SEQ ID NO: 394 - DNA, 23 bp, Artificial
  gRNA target site sequence
gtttttgtcttcctctctgtagg

SEQ ID NO: 395 - DNA, 23 bp, Artificial
  gRNA target site sequence
ctctctgtaggcacccagattgg

SEQ ID NO: 396 - DNA, 23 bp, Artificial
  gRNA target site sequence
tgtgtctgccatttagctactgg

SEQ ID NO: 397 - DNA, 23 bp, Artificial
  gRNA target site sequence
gtgtctgccatttagctactggg

SEQ ID NO: 398 - DNA, 23 bp, Artificial
  gRNA target site sequence
tgtctgccatttagctactgggg

SEQ ID NO: 399 - DNA, 23 bp, Artificial
  gRNA target site sequence
tagctactggggacatgctgagg

SEQ ID NO: 400 - DNA, 23 bp, Artificial
  gRNA target site sequence
agctactggggacatgctgaggg

SEQ ID NO: 401 - DNA, 23 bp, Artificial
  gRNA target site sequence
tggggacatgctgagggccatgg

SEQ ID NO: 402 - DNA, 23 bp, Artificial
  gRNA target site sequence
ggacatgctgagggccatggtgg

SEQ ID NO: 403 - DNA, 23 bp, Artificial
  gRNA target site sequence
ctgagggccatggtggcttctgg

SEQ ID NO: 404 - DNA, 23 bp, Artificial
  gRNA target site sequence
gtggcttctggctcagagctagg

SEQ ID NO: 405 - DNA, 23 bp, Artificial
  gRNA target site sequence
agagctaggaaaaaagctgaagg

SEQ ID NO: 406 - DNA, 23 bp, Artificial
  gRNA target site sequence
aaaaaagctgaaggcaactatgg

SEQ ID NO: 407 - DNA, 23 bp, Artificial
  gRNA target site sequence
ctgaaggcaactatggatgctgg

SEQ ID NO: 408 - DNA, 23 bp, Artificial
  gRNA target site sequence
tgaaggcaactatggatgctggg

SEQ ID NO: 409 - DNA, 23 bp, Artificial
  gRNA target site sequence
aactatggatgctgggaaactgg

SEQ ID NO: 410 - DNA, 23 bp, Artificial
  gRNA target site sequence
atggatgctgggaaactggtagg

SEQ ID NO: 411 - DNA, 23 bp, Artificial
  gRNA target site sequence
tgctgggaaactggtaggtttgg

SEQ ID NO: 412 - DNA, 23 bp, Artificial
  gRNA target site sequence
tgggaaactggtaggtttggtgg

SEQ ID NO: 413 - DNA, 23 bp, Artificial
  gRNA target site sequence
caatctgggtgcctacagagagg

SEQ ID NO: 414 - DNA, 23 bp, Artificial
  gRNA target site sequence
cagaagttttcagccaatctggg

SEQ ID NO: 415 - DNA, 23 bp, Artificial
  gRNA target site sequence
acagaagttttcagccaatctgg

SEQ ID NO: 416 - DNA, 23 bp, Artificial
  gRNA target site sequence
gcatgtccccagtagctaaatgg

SEQ ID NO: 417 - DNA, 23 bp, Artificial
  gRNA target site sequence
ctctgagccagaagccaccatgg

SEQ ID NO: 418 - DNA, 23 bp, Artificial
  gRNA target site sequence
gtggcagtgagagacttcggcgg

SEQ ID NO: 419 - DNA, 23 bp, Artificial
  gRNA target site sequence
gtgagagacttcggcggacatgg

SEQ ID NO: 420 - DNA, 23 bp, Artificial
  gRNA target site sequence
catggctcccagcgtgccagcgg

SEQ ID NO: 421 - DNA, 23 bp, Artificial
  gRNA target site sequence
gcagaacccgagtatcctaaagg

SEQ ID NO: 422 - DNA, 23 bp, Artificial
  gRNA target site sequence
ccgagtatcctaaaggcatccgg

SEQ ID NO: 423 - DNA, 23 bp, Artificial
  gRNA target site sequence
cgagtatcctaaaggcatccggg

SEQ ID NO: 424 - DNA, 23 bp, Artificial
  gRNA target site sequence
aggcatccgggccgtgctgctgg

SEQ ID NO: 425 - DNA, 23 bp, Artificial
  gRNA target site sequence
ggcatccgggccgtgctgctggg

SEQ ID NO: 426 - DNA, 23 bp, Artificial
  gRNA target site sequence
gcatccgggccgtgctgctgggg

SEQ ID NO: 427 - DNA, 23 bp, Artificial
  gRNA target site sequence
gccgtgctgctggggcctcccgg

SEQ ID NO: 428 - DNA, 23 bp, Artificial
  gRNA target site sequence
ccgtgctgctggggcctcccggg

SEQ ID NO: 429 - DNA, 23 bp, Artificial
  gRNA target site sequence
cgtgctgctggggcctcccgggg

SEQ ID NO: 430 - DNA, 23 bp, Artificial
  gRNA target site sequence
ctgctggggcctcccggggccgg

SEQ ID NO: 431 - DNA, 23 bp, Artificial
  gRNA target site sequence
gggcctcccggggccggtaaagg

SEQ ID NO: 432 - DNA, 23 bp, Artificial
  gRNA target site sequence
ggcctcccggggccggtaaaggg

SEQ ID NO: 433 - DNA, 23 bp, Artificial
  gRNA target site sequence
cggggccggtaaagggacccagg

SEQ ID NO: 434 - DNA, 23 bp, Artificial
  gRNA target site sequence
ggtaaagggacccaggtgagcgg

SEQ ID NO: 435 - DNA, 23 bp, Artificial
  gRNA target site sequence
aagggacccaggtgagcggcagg

SEQ ID NO: 436 - DNA, 23 bp, Artificial
  gRNA target site sequence
acccaggtgagcggcaggactgg

SEQ ID NO: 437 - DNA, 23 bp, Artificial
  gRNA target site sequence
cccaggtgagcggcaggactggg

SEQ ID NO: 438 - DNA, 23 bp, Artificial
  gRNA target site sequence
gtgagcggcaggactgggcttgg

SEQ ID NO: 439 - DNA, 23 bp, Artificial
  gRNA target site sequence
ggttctgccgctggcacgctggg

SEQ ID NO: 440 - DNA, 23 bp, Artificial
  gRNA target site sequence
gggttctgccgctggcacgctgg

SEQ ID NO: 441 - DNA, 23 bp, Artificial
  gRNA target site sequence
ggatactcgggttctgccgctgg

SEQ ID NO: 442 - DNA, 23 bp, Artificial
  gRNA target site sequence
cggatgcctttaggatactcggg

SEQ ID NO: 443 - DNA, 23 bp, Artificial
  gRNA target site sequence
ccggatgcctttaggatactcgg

SEQ ID NO: 444 - DNA, 23 bp, Artificial
  gRNA target site sequence
agcacggcccggatgcctttagg

SEQ ID NO: 445 - DNA, 23 bp, Artificial
  gRNA target site sequence
gaggccccagcagcacggcccgg

SEQ ID NO: 446 - DNA, 23 bp, Artificial
  gRNA target site sequence
cccgggaggccccagcagcacgg

SEQ ID NO: 447 - DNA, 23 bp, Artificial
  gRNA target site sequence
gtccctttaccggccccgggagg

SEQ ID NO: 448 - DNA, 23 bp, Artificial
  gRNA target site sequence
tgggtccctttaccggccccggg

SEQ ID NO: 449 - DNA, 23 bp, Artificial
  gRNA target site sequence
ctgggtccctttaccggccccgg

SEQ ID NO: 450 - DNA, 23 bp, Artificial
  gRNA target site sequence
gctcacctgggtccctttaccgg

SEQ ID NO: 451 - DNA, 23 bp, Artificial
  gRNA target site sequence
cccagtcctgccgctcacctggg

SEQ ID NO: 452 - DNA, 23 bp, Artificial
  gRNA target site sequence
gcccagtcctgccgctcacctgg

SEQ ID NO: 453 - DNA, 23 bp, Artificial
  gRNA target site sequence
gatgctcagtacagccaccttgg

SEQ ID NO: 454 - DNA, 23 bp, Artificial
  gRNA target site sequence
gctcagtacagccaccttggagg

SEQ ID NO: 455 - DNA, 23 bp, Artificial
  gRNA target site sequence
acagccaccttggaggaaactgg

SEQ ID NO: 456 - DNA, 23 bp, Artificial
  gRNA target site sequence
cagccaccttggaggaaactggg

SEQ ID NO: 457 - DNA, 23 bp, Artificial
  gRNA target site sequence
accttggaggaaactgggctcgg

SEQ ID NO: 458 - DNA, 23 bp, Artificial
  gRNA target site sequence
ggaacaagtgaacctgagactgg

SEQ ID NO: 459 - DNA, 23 bp, Artificial
  gRNA target site sequence
acaagtgaacctgagactggtgg

SEQ ID NO: 460 - DNA, 23 bp, Artificial
  gRNA target site sequence
taagagaggagaagagaaaacgg

SEQ ID NO: 461 - DNA, 23 bp, Artificial
  gRNA target site sequence
gatctcggaggggctaagagagg

SEQ ID NO: 462 - DNA, 23 bp, Artificial
  gRNA target site sequence
gcatcatctcgatctcggagggg

SEQ ID NO: 463 - DNA, 23 bp, Artificial
  gRNA target site sequence
agcatcatctcgatctcggaggg

SEQ ID NO: 464 - DNA, 23 bp, Artificial
  gRNA target site sequence
gagcatcatctcgatctcggagg

SEQ ID NO: 465 - DNA, 23 bp, Artificial
  gRNA target site sequence
actgagcatcatctcgatctcgg

SEQ ID NO: 466 - DNA, 23 bp, Artificial
  gRNA target site sequence
gagcccagtttcctccaaggtgg

SEQ ID NO: 467 - DNA, 23 bp, Artificial
  gRNA target site sequence
tccgagcccagtttcctccaagg

SEQ ID NO: 468 - DNA, 23 bp, Artificial
  gRNA target site sequence
ttctagaagccaccagtctcagg

SEQ ID NO: 469 - DNA, 23 bp, Artificial
  gRNA target site sequence
ccgacacacaagctctgttgagg

SEQ ID NO: 470 - DNA, 23 bp, Artificial
  gRNA target site sequence
agctctgttgaggaatgaccagg

SEQ ID NO: 471 - DNA, 23 bp, Artificial
  gRNA target site sequence
gaggaatgaccaggtctatcagg

SEQ ID NO: 472 - DNA, 23 bp, Artificial
  gRNA target site sequence
ggtctatcaggtgagcgttgagg

SEQ ID NO: 473 - DNA, 23 bp, Artificial
  gRNA target site sequence
gtctatcaggtgagcgttgaggg

SEQ ID NO: 474 - DNA, 23 bp, Artificial
  gRNA target site sequence
tctatcaggtgagcgttgagggg

SEQ ID NO: 475 - DNA, 23 bp, Artificial
  gRNA target site sequence
tcaggtgagcgttgaggggaagg

SEQ ID NO: 476 - DNA, 23 bp, Artificial
  gRNA target site sequence
ggtgagcgttgaggggaaggagg

SEQ ID NO: 477 - DNA, 23 bp, Artificial
  gRNA target site sequence
cctcaacagagcttgtgtgtcgg

SEQ ID NO: 478 - DNA, 23 bp, Artificial
  gRNA target site sequence
caacgctcacctgatagacctgg

SEQ ID NO: 479 - DNA, 23 bp, Artificial
  gRNA target site sequence
cacagtgtgccagagctgtgtgg

SEQ ID NO: 480 - DNA, 23 bp, Artificial
  gRNA target site sequence
gtgccagagctgtgtggagctgg

SEQ ID NO: 481 - DNA, 23 bp, Artificial
  gRNA target site sequence
ggagctggatccagccaccgtgg

SEQ ID NO: 482 - DNA, 23 bp, Artificial
  gRNA target site sequence
ctggatccagccaccgtggctgg

SEQ ID NO: 483 - DNA, 23 bp, Artificial
  gRNA target site sequence
tgccactctgctccttgctttgg

SEQ ID NO: 484 - DNA, 23 bp, Artificial
  gRNA target site sequence
gccactctgctccttgctttggg

SEQ ID NO: 485 - DNA, 23 bp, Artificial
  gRNA target site sequence
ttgggagtcttctgctttgctgg

SEQ ID NO: 486 - DNA, 23 bp, Artificial
  gRNA target site sequence
tgctttgctggacatgagactgg

SEQ ID NO: 487 - DNA, 23 bp, Artificial
  gRNA target site sequence
ttgctggacatgagactggaagg

SEQ ID NO: 488 - DNA, 23 bp, Artificial
  gRNA target site sequence
catgagactggaaggctgtctgg

SEQ ID NO: 489 - DNA, 23 bp, Artificial
  gRNA target site sequence
atgagactggaaggctgtctggg

SEQ ID NO: 490 - DNA, 23 bp, Artificial
  gRNA target site sequence
tgagactggaaggctgtctgggg

SEQ ID NO: 491 - DNA, 23 bp, Artificial
  gRNA target site sequence
gagactggaaggctgtctggggg

SEQ ID NO: 492 - DNA, 23 bp, Artificial
  gRNA target site sequence
gaaggctgtctgggggttagtgg

SEQ ID NO: 493 - DNA, 23 bp, Artificial
  gRNA target site sequence
tgtgggggaagggaggagagagg

SEQ ID NO: 494 - DNA, 23 bp, Artificial
  gRNA target site sequence
ggcacactgtgggggaagggagg

SEQ ID NO: 495 - DNA, 23 bp, Artificial
  gRNA target site sequence
tctggcacactgtgggggaaggg

SEQ ID NO: 496 - DNA, 23 bp, Artificial
  gRNA target site sequence
ctctggcacactgtgggggaagg

SEQ ID NO: 497 - DNA, 23 bp, Artificial
  gRNA target site sequence
acagctctggcacactgtggggg

SEQ ID NO: 498 - DNA, 23 bp, Artificial
  gRNA target site sequence
cacagctctggcacactgtgggg

SEQ ID NO: 499 - DNA, 23 bp, Artificial
  gRNA target site sequence
acacagctctggcacactgtggg

SEQ ID NO: 500 - DNA, 23 bp, Artificial
  gRNA target site sequence
cacacagctctggcacactgtgg

SEQ ID NO: 501 - DNA, 23 bp, Artificial
  gRNA target site sequence
gatccagctccacacagctctgg

SEQ ID NO: 502 - DNA, 23 bp, Artificial
  gRNA target site sequence
atgatgccagccacggtggctgg

SEQ ID NO: 503 - DNA, 23 bp, Artificial
  gRNA target site sequence
gacaatgatgccagccacggtgg

SEQ ID NO: 504 - DNA, 23 bp, Artificial
  gRNA target site sequence
agtgacaatgatgccagccacgg

SEQ ID NO: 505 - DNA, 23 bp, Artificial
  gRNA target site sequence
tcccaaagcaaggagcagagtgg

SEQ ID NO: 506 - DNA, 23 bp, Artificial
  gRNA target site sequence
agcagaagactcccaaagcaagg

SEQ ID NO: 507 - DNA, 23 bp, Artificial
  gRNA target site sequence
ccccttcaagatacctatagagg

SEQ ID NO: 508 - DNA, 23 bp, Artificial
  gRNA target site sequence
gatacctatagaggaacttgagg

SEQ ID NO: 509 - DNA, 23 bp, Artificial
  gRNA target site sequence
attgcaataccagcatcacatgg

SEQ ID NO: 510 - DNA, 23 bp, Artificial
  gRNA target site sequence
ttgcaataccagcatcacatggg

SEQ ID NO: 511 - DNA, 23 bp, Artificial
  gRNA target site sequence
taccagcatcacatgggtagagg

SEQ ID NO: 512 - DNA, 23 bp, Artificial
  gRNA target site sequence
accagcatcacatgggtagaggg

SEQ ID NO: 513 - DNA, 23 bp, Artificial
  gRNA target site sequence
catcacatgggtagagggaacgg

SEQ ID NO: 514 - DNA, 23 bp, Artificial
  gRNA target site sequence
cacatgggtagagggaacggtgg

SEQ ID NO: 515 - DNA, 23 bp, Artificial
  gRNA target site sequence
acatgggtagagggaacggtggg

SEQ ID NO: 516 - DNA, 23 bp, Artificial
  gRNA target site sequence
gctctcagacattacaagactgg

SEQ ID NO: 517 - DNA, 23 bp, Artificial
  gRNA target site sequence
agacattacaagactggacctgg

SEQ ID NO: 518 - DNA, 23 bp, Artificial
  gRNA target site sequence
gacattacaagactggacctggg

SEQ ID NO: 519 - DNA, 23 bp, Artificial
  gRNA target site sequence
ggacctgggaaaacgcatcctgg

SEQ ID NO: 520 - DNA, 23 bp, Artificial
  gRNA target site sequence
aaacgcatcctggacccacgagg

SEQ ID NO: 521 - DNA, 23 bp, Artificial
  gRNA target site sequence
tggacccacgaggaatatatagg

SEQ ID NO: 522 - DNA, 23 bp, Artificial
  gRNA target site sequence
cgaggaatatataggtgtaatgg

SEQ ID NO: 523 - DNA, 23 bp, Artificial
  gRNA target site sequence
gaggaatatataggtgtaatggg

SEQ ID NO: 524 - DNA, 23 bp, Artificial
  gRNA target site sequence
taatgggacagatatatacaagg

SEQ ID NO: 525 - DNA, 23 bp, Artificial
  gRNA target site sequence
tacgtgcttcctgaaccctttgg

SEQ ID NO: 526 - DNA, 23 bp, Artificial
  gRNA target site sequence
acgtgcttcctgaaccctttggg

SEQ ID NO: 527 - DNA, 23 bp, Artificial
  gRNA target site sequence
cttgaaggggctcactaaagggg

SEQ ID NO: 528 - DNA, 23 bp, Artificial
  gRNA target site sequence
tcttgaaggggctcactaaaggg

SEQ ID NO: 529 - DNA, 23 bp, Artificial
  gRNA target site sequence
atcttgaaggggctcactaaagg

SEQ ID NO: 530 - DNA, 23 bp, Artificial
  gRNA target site sequence
cctctataggtatcttgaagggg

SEQ ID NO: 531 - DNA, 23 bp, Artificial
  gRNA target site sequence
tcctctataggtatcttgaaggg

SEQ ID NO: 532 - DNA, 23 bp, Artificial
  gRNA target site sequence
ttcctctataggtatcttgaagg

SEQ ID NO: 533 - DNA, 23 bp, Artificial
  gRNA target site sequence
ctgtcctcaagttcctctatagg

SEQ ID NO: 534 - DNA, 23 bp, Artificial
  gRNA target site sequence
tccctctacccatgtgatgctgg

SEQ ID NO: 535 - DNA, 23 bp, Artificial
  gRNA target site sequence
ggtccaggatgcgttttcccagg

SEQ ID NO: 536 - DNA, 23 bp, Artificial
  gRNA target site sequence
tatatattcctcgtgggtccagg

SEQ ID NO: 537 - DNA, 23 bp, Artificial
  gRNA target site sequence
tacacctatatattcctcgtggg

SEQ ID NO: 538 - DNA, 23 bp, Artificial
  gRNA target site sequence
ttacacctatatattcctcgtgg

SEQ ID NO: 539 - DNA, 23 bp, Artificial
  gRNA target site sequence
acttcgataatgaacttgcacgg

SEQ ID NO: 540 - DNA, 23 bp, Artificial
  gRNA target site sequence
tctactggatgagttccgctggg

SEQ ID NO: 541 - DNA, 23 bp, Artificial
  gRNA target site sequence
ggatgagttccgctgggagatgg

SEQ ID NO: 542 - DNA, 23 bp, Artificial
  gRNA target site sequence
gaacatagcacgtttctctctgg

SEQ ID NO: 543 - DNA, 23 bp, Artificial
  gRNA target site sequence
tagcacgtttctctctggcctgg

SEQ ID NO: 544 - DNA, 23 bp, Artificial
  gRNA target site sequence
gtttctctctggcctggtactgg

SEQ ID NO: 545 - DNA, 23 bp, Artificial
  gRNA target site sequence
ctggctacccttctctcgcaagg

SEQ ID NO: 546 - DNA, 23 bp, Artificial
  gRNA target site sequence
tacccttctctcgcaaggtaagg

SEQ ID NO: 547 - DNA, 23 bp, Artificial
  gRNA target site sequence
tcgcaaggtaaggctactccagg

SEQ ID NO: 548 - DNA, 23 bp, Artificial
  gRNA target site sequence
caaggtaaggctactccaggtgg

SEQ ID NO: 549 - DNA, 23 bp, Artificial
  gRNA target site sequence
aaggtaaggctactccaggtggg

SEQ ID NO: 550 - DNA, 23 bp, Artificial
  gRNA target site sequence
gtaaggctactccaggtgggtgg

SEQ ID NO: 551 - DNA, 23 bp, Artificial
  gRNA target site sequence
taaggctactccaggtgggtggg

SEQ ID NO: 552 - DNA, 23 bp, Artificial
  gRNA target site sequence
aaggctactccaggtgggtgggg

SEQ ID NO: 553 - DNA, 23 bp, Artificial
  gRNA target site sequence
tgctatgttccatctcccagcgg

SEQ ID NO: 554 - DNA, 23 bp, Artificial
  gRNA target site sequence
agagaagggtagccagtaccagg

SEQ ID NO: 555 - DNA, 23 bp, Artificial
  gRNA target site sequence
agccttaccttgcgagagaaggg

SEQ ID NO: 556 - DNA, 23 bp, Artificial
  gRNA target site sequence
tagccttaccttgcgagagaagg

SEQ ID NO: 557 - DNA, 23 bp, Artificial
  gRNA target site sequence
ctgttttgtttgtcccacagagg

SEQ ID NO: 558 - DNA, 23 bp, Artificial
  gRNA target site sequence
ttttgtttgtcccacagaggagg

SEQ ID NO: 559 - DNA, 23 bp, Artificial
  gRNA target site sequence
atcctctgccaatacctttaagg

SEQ ID NO: 560 - DNA, 23 bp, Artificial
  gRNA target site sequence
aaggcacaaagttccatacccgg

SEQ ID NO: 561 - DNA, 23 bp, Artificial
  gRNA target site sequence
cccggaaacttttcaccctgagg

SEQ ID NO: 562 - DNA, 23 bp, Artificial
  gRNA target site sequence
gaaaaactgagacaaaccccagg

SEQ ID NO: 563 - DNA, 23 bp, Artificial
  gRNA target site sequence
agtgaaagtgaagaagaagtagg

SEQ ID NO: 564 - DNA, 23 bp, Artificial
  gRNA target site sequence
ggaatcccagcttcactgcaagg

SEQ ID NO: 565 - DNA, 23 bp, Artificial
  gRNA target site sequence
agcttcactgcaaggagatctgg

SEQ ID NO: 566 - DNA, 23 bp, Artificial
  gRNA target site sequence
gcttcactgcaaggagatctggg

SEQ ID NO: 567 - DNA, 23 bp, Artificial
  gRNA target site sequence
ctctgtacttcacctgcaaaagg

SEQ ID NO: 568 - DNA, 23 bp, Artificial
  gRNA target site sequence
cttcacctgcaaaaggctgatgg

SEQ ID NO: 569 - DNA, 23 bp, Artificial
  gRNA target site sequence
ttcacctgcaaaaggctgatggg

SEQ ID NO: 570 - DNA, 23 bp, Artificial
  gRNA target site sequence
tcacctgcaaaaggctgatgggg

SEQ ID NO: 571 - DNA, 23 bp, Artificial
  gRNA target site sequence
ctgatggggatgtaccccagtgg

SEQ ID NO: 572 - DNA, 23 bp, Artificial
  gRNA target site sequence
tgatggggatgtaccccagtggg

SEQ ID NO: 573 - DNA, 23 bp, Artificial
  gRNA target site sequence
tgaaatcacagatgagagtttgg

SEQ ID NO: 574 - DNA, 23 bp, Artificial
  gRNA target site sequence
aaacttcccttcctccacagtgg

SEQ ID NO: 575 - DNA, 23 bp, Artificial
  gRNA target site sequence
ttcccttcctccacagtggcagg

SEQ ID NO: 576 - DNA, 23 bp, Artificial
  gRNA target site sequence
tcccttcctccacagtggcaggg

SEQ ID NO: 577 - DNA, 23 bp, Artificial
  gRNA target site sequence
cccttcctccacagtggcagggg

SEQ ID NO: 578 - DNA, 23 bp, Artificial
  gRNA target site sequence
ccttcctccacagtggcaggggg

SEQ ID NO: 579 - DNA, 23 bp, Artificial
  gRNA target site sequence
aagcttttcagtgactctgatgg

SEQ ID NO: 580 - DNA, 23 bp, Artificial
  gRNA target site sequence
tcaacacacataacagaacaagg

SEQ ID NO: 581 - DNA, 23 bp, Artificial
  gRNA target site sequence
ataacagaacaaggaagtcaagg

SEQ ID NO: 582 - DNA, 23 bp, Artificial
  gRNA target site sequence
cagaacaaggaagtcaaggctgg

SEQ ID NO: 583 - DNA, 23 bp, Artificial
  gRNA target site sequence
agaacaaggaagtcaaggctggg

SEQ ID NO: 584 - DNA, 23 bp, Artificial
  gRNA target site sequence
tcttcccaagagagaaacagtgg

SEQ ID NO: 585 - DNA, 23 bp, Artificial
  gRNA target site sequence
cttcccaagagagaaacagtggg

SEQ ID NO: 586 - DNA, 23 bp, Artificial
  gRNA target site sequence
ttcccaagagagaaacagtgggg

SEQ ID NO: 587 - DNA, 23 bp, Artificial
  gRNA target site sequence
cagtggggatattacttccttgg

SEQ ID NO: 588 - DNA, 23 bp, Artificial
  gRNA target site sequence
gaatattcctgcctctctcatgg

SEQ ID NO: 589 - DNA, 23 bp, Artificial
  gRNA target site sequence
acaaaatgtaatttgcccaaagg

SEQ ID NO: 590 - DNA, 23 bp, Artificial
  gRNA target site sequence
gtgacaatagttcctagtactgg

SEQ ID NO: 591 - DNA, 23 bp, Artificial
  gRNA target site sequence
cagtgagacacatatacccgagg

SEQ ID NO: 592 - DNA, 23 bp, Artificial
  gRNA target site sequence
acaatatttatatgagaagctgg

SEQ ID NO: 593 - DNA, 23 bp, Artificial
  gRNA target site sequence
ttatatgagaagctggcaactgg

SEQ ID NO: 594 - DNA, 23 bp, Artificial
  gRNA target site sequence
ctctgtgggacaaacaaaacagg

SEQ ID NO: 595 - DNA, 23 bp, Artificial
  gRNA target site sequence
tagtcatcttcctcctctgtggg

SEQ ID NO: 596 - DNA, 23 bp, Artificial
  gRNA target site sequence
atagtcatcttcctcctctgtgg

SEQ ID NO: 597 - DNA, 23 bp, Artificial
  gRNA target site sequence
tgccttaaaggtattggcagagg

SEQ ID NO: 598 - DNA, 23 bp, Artificial
  gRNA target site sequence
actttgtgccttaaaggtattgg

SEQ ID NO: 599 - DNA, 23 bp, Artificial
  gRNA target site sequence
tatggaactttgtgccttaaagg

SEQ ID NO: 600 - DNA, 23 bp, Artificial
  gRNA target site sequence
gggtgaaaagtttccgggtatgg

SEQ ID NO: 601 - DNA, 23 bp, Artificial
  gRNA target site sequence
cctcagggtgaaaagtttccggg

SEQ ID NO: 602 - DNA, 23 bp, Artificial
  gRNA target site sequence
acctcagggtgaaaagtttccgg

SEQ ID NO: 603 - DNA, 23 bp, Artificial
  gRNA target site sequence
cagtcattgaaaatacctcaggg

SEQ ID NO: 604 - DNA, 23 bp, Artificial
  gRNA target site sequence
gcagtcattgaaaatacctcagg

SEQ ID NO: 605 - DNA, 23 bp, Artificial
  gRNA target site sequence
ggggtttgtctcagtttttcagg

SEQ ID NO: 606 - DNA, 23 bp, Artificial
  gRNA target site sequence
ctctgctctgcagcatcctgggg

SEQ ID NO: 607 - DNA, 23 bp, Artificial
  gRNA target site sequence
actctgctctgcagcatcctggg

SEQ ID NO: 608 - DNA, 23 bp, Artificial
  gRNA target site sequence
cactctgctctgcagcatcctgg

SEQ ID NO: 609 - DNA, 23 bp, Artificial
  gRNA target site sequence
ttcttcttcactttcactgttgg

SEQ ID NO: 610 - DNA, 23 bp, Artificial
  gRNA target site sequence
gatctccttgcagtgaagctggg

SEQ ID NO: 611 - DNA, 23 bp, Artificial
  gRNA target site sequence
agatctccttgcagtgaagctgg

SEQ ID NO: 612 - DNA, 23 bp, Artificial
  gRNA target site sequence
catccccatcagccttttgcagg

SEQ ID NO: 613 - DNA, 23 bp, Artificial
  gRNA target site sequence
ttaaagaatacttcccactgggg

SEQ ID NO: 614 - DNA, 23 bp, Artificial
  gRNA target site sequence
tttaaagaatacttcccactggg

SEQ ID NO: 615 - DNA, 23 bp, Artificial
  gRNA target site sequence
ttttaaagaatacttcccactgg

SEQ ID NO: 616 - DNA, 23 bp, Artificial
  gRNA target site sequence
cccctgccactgtggaggaaggg

SEQ ID NO: 617 - DNA, 23 bp, Artificial
  gRNA target site sequence
ccccctgccactgtggaggaagg

SEQ ID NO: 618 - DNA, 23 bp, Artificial
  gRNA target site sequence
agatccccctgccactgtggagg

SEQ ID NO: 619 - DNA, 23 bp, Artificial
  gRNA target site sequence
ctgagatccccctgccactgtgg

SEQ ID NO: 620 - DNA, 23 bp, Artificial
  gRNA target site sequence
tcagagtcactgaaaagctttgg

SEQ ID NO: 621 - DNA, 23 bp, Artificial
  gRNA target site sequence
tgactgggaagaattctgggagg

SEQ ID NO: 622 - DNA, 23 bp, Artificial
  gRNA target site sequence
tgttgactgggaagaattctggg

SEQ ID NO: 623 - DNA, 23 bp, Artificial
  gRNA target site sequence
gtgttgactgggaagaattctgg

SEQ ID NO: 624 - DNA, 23 bp, Artificial
  gRNA target site sequence
ttctgttatgtgtgttgactggg

SEQ ID NO: 625 - DNA, 23 bp, Artificial
  gRNA target site sequence
gttctgttatgtgtgttgactgg

SEQ ID NO: 626 - DNA, 23 bp, Artificial
  gRNA target site sequence
ataacaaaacagtatcagattgg

SEQ ID NO: 627 - DNA, 23 bp, Artificial
  gRNA target site sequence
atccccactgtttctctcttggg

SEQ ID NO: 628 - DNA, 23 bp, Artificial
  gRNA target site sequence
tatccccactgtttctctcttgg

SEQ ID NO: 629 - DNA, 23 bp, Artificial
  gRNA target site sequence
tctgtagtcagctttgtccaagg

SEQ ID NO: 630 - DNA, 23 bp, Artificial
  gRNA target site sequence
ggaatattctctttgattgttgg

SEQ ID NO: 631 - DNA, 23 bp, Artificial
  gRNA target site sequence
ttttgttccatgagagaggcagg

SEQ ID NO: 632 - DNA, 23 bp, Artificial
  gRNA target site sequence
tacattttgttccatgagagagg

SEQ ID NO: 633 - DNA, 23 bp, Artificial
  gRNA target site sequence
aatcagagtaagtatcctttggg

SEQ ID NO: 634 - DNA, 23 bp, Artificial
  gRNA target site sequence
aaatcagagtaagtatcctttgg

SEQ ID NO: 635 - DNA, 23 bp, Artificial
  gRNA target site sequence
gtagttggttctccagtactagg

SEQ ID NO: 636 - DNA, 23 bp, Artificial
  gRNA target site sequence
gtctcactgcttagagtagttgg

SEQ ID NO: 637 - DNA, 23 bp, Artificial
  gRNA target site sequence
tttagcaaacttttttcctcggg

SEQ ID NO: 638 - DNA, 23 bp, Artificial
  gRNA target site sequence
atttagcaaacttttttcctcgg

SEQ ID NO: 639 - DNA, 23 bp, Artificial
  gRNA target site sequence
ttcaaaatcagaagagctctggg

SEQ ID NO: 640 - DNA, 23 bp, Artificial
  gRNA target site sequence
cttcaaaatcagaagagctctgg

SEQ ID NO: 641 - DNA, 23 bp, Artificial
  gRNA target site sequence
aactcagcttctggagttgaggg

SEQ ID NO: 642 - DNA, 23 bp, Artificial
  gRNA target site sequence
taactcagcttctggagttgagg

SEQ ID NO: 643 - DNA, 23 bp, Artificial
  gRNA target site sequence
cgtttaggtaactcagcttctgg

SEQ ID NO: 644 - DNA, 23 bp, Artificial
  gRNA target site sequence
tattgtaaatgctctcgtttagg

SEQ ID NO: 645 - DNA, 23 bp, Artificial
  gRNA target site sequence
ttgaaacgctttgaattcttagg

SEQ ID NO: 646 - DNA, 23 bp, Artificial
  gRNA target site sequence
tcagcttaaagcctttatgccgg

SEQ ID NO: 647 - DNA, 23 bp, Artificial
  gRNA target site sequence
atgccggtcttcccaaagtacgg

SEQ ID NO: 648 - DNA, 23 bp, Artificial
  gRNA target site sequence
ggagccaaagtataaaccactgg

SEQ ID NO: 649 - DNA, 23 bp, Artificial
  gRNA target site sequence
gagccaaagtataaaccactggg

SEQ ID NO: 650 - DNA, 23 bp, Artificial
  gRNA target site sequence
agaacagttcaccgagactcagg

SEQ ID NO: 651 - DNA, 23 bp, Artificial
  gRNA target site sequence
cgagactcaggtaagaaaaatgg

SEQ ID NO: 652 - DNA, 23 bp, Artificial
  gRNA target site sequence
tcaggtaagaaaaatggtcctgg

SEQ ID NO: 653 - DNA, 23 bp, Artificial
  gRNA target site sequence
caggtaagaaaaatggtcctggg

SEQ ID NO: 654 - DNA, 23 bp, Artificial
  gRNA target site sequence
ctttgggaagaccggcataaagg

SEQ ID NO: 655 - DNA, 23 bp, Artificial
  gRNA target site sequence
gctccgtactttgggaagaccgg

SEQ ID NO: 656 - DNA, 23 bp, Artificial
  gRNA target site sequence
atactttggctccgtactttggg

SEQ ID NO: 657 - DNA, 23 bp, Artificial
  gRNA target site sequence
tatactttggctccgtactttgg

SEQ ID NO: 658 - DNA, 23 bp, Artificial
  gRNA target site sequence
tttcccagtggtttatactttgg

SEQ ID NO: 659 - DNA, 23 bp, Artificial
  gRNA target site sequence
gctctcttcagttttcccagtgg

SEQ ID NO: 660 - DNA, 23 bp, Artificial
  gRNA target site sequence
catttttcttacctgagtctcgg

SEQ ID NO: 661 - DNA, 23 bp, Artificial
  gRNA target site sequence
tatccaaatgtcattccagttgg

SEQ ID NO: 662 - DNA, 23 bp, Artificial
  gRNA target site sequence
cattccagttggcacaactatgg

SEQ ID NO: 663 - DNA, 23 bp, Artificial
  gRNA target site sequence
gtcgaaatgtgagtagtcactgg

SEQ ID NO: 664 - DNA, 23 bp, Artificial
  gRNA target site sequence
atgtgagtagtcactggttgtgg

SEQ ID NO: 665 - DNA, 23 bp, Artificial
  gRNA target site sequence
tgtgagtagtcactggttgtggg

SEQ ID NO: 666 - DNA, 23 bp, Artificial
  gRNA target site sequence
ctagaaaaaggaaaatcacatgg

SEQ ID NO: 667 - DNA, 23 bp, Artificial
  gRNA target site sequence
gaaatctttaatctagaaaaagg

SEQ ID NO: 668 - DNA, 23 bp, Artificial
  gRNA target site sequence
gatatgcgttcacaggacagagg

SEQ ID NO: 669 - DNA, 23 bp, Artificial
  gRNA target site sequence
acatttggatatgcgttcacagg

SEQ ID NO: 670 - DNA, 23 bp, Artificial
  gRNA target site sequence
gtgccaactggaatgacatttgg

SEQ ID NO: 671 - DNA, 23 bp, Artificial
  gRNA target site sequence
ttatccatagttgtgccaactgg

SEQ ID NO: 672 - DNA, 23 bp, Artificial
  gRNA target site sequence
ttgtgttttcacttccctttagg

SEQ ID NO: 673 - DNA, 23 bp, Artificial
  gRNA target site sequence
ttttcacttccctttaggactgg

SEQ ID NO: 674 - DNA, 23 bp, Artificial
  gRNA target site sequence
ttttcactcctcctacagtgagg

SEQ ID NO: 675 - DNA, 23 bp, Artificial
  gRNA target site sequence
tcctcctacagtgaggtaagagg

SEQ ID NO: 676 - DNA, 23 bp, Artificial
  gRNA target site sequence
gaactctctccagtcctaaaggg

SEQ ID NO: 677 - DNA, 23 bp, Artificial
  gRNA target site sequence
tgaactctctccagtcctaaagg

SEQ ID NO: 678 - DNA, 23 bp, Artificial
  gRNA target site sequence
tcctcttacctcactgtaggagg

SEQ ID NO: 679 - DNA, 23 bp, Artificial
  gRNA target site sequence
ggatcctcttacctcactgtagg

SEQ ID NO: 680 - DNA, 23 bp, Artificial
  gRNA target site sequence
ctatgctttttatcttttttagg

SEQ ID NO: 681 - DNA, 23 bp, Artificial
  gRNA target site sequence
tttttatcttttttaggcagagg

SEQ ID NO: 682 - DNA, 23 bp, Artificial
  gRNA target site sequence
aggcagaggaatattttcagtgg

SEQ ID NO: 683 - DNA, 23 bp, Artificial
  gRNA target site sequence
cagtggagcaaattaccctgtgg

SEQ ID NO: 684 - DNA, 23 bp, Artificial
  gRNA target site sequence
gcattaagccatccaccatgtgg

SEQ ID NO: 685 - DNA, 23 bp, Artificial
  gRNA target site sequence
aagccatccaccatgtggtttgg

SEQ ID NO: 686 - DNA, 23 bp, Artificial
  gRNA target site sequence
ccaccatgtggtttggagaaagg

SEQ ID NO: 687 - DNA, 23 bp, Artificial
  gRNA target site sequence
gaaaaacaaatgtaattgtgagg

SEQ ID NO: 688 - DNA, 23 bp, Artificial
  gRNA target site sequence
aggtaagagagcaatatcatagg

SEQ ID NO: 689 - DNA, 23 bp, Artificial
  gRNA target site sequence
tttctggaagtaattccacaggg

SEQ ID NO: 690 - DNA, 23 bp, Artificial
  gRNA target site sequence
atttctggaagtaattccacagg

SEQ ID NO: 691 - DNA, 23 bp, Artificial
  gRNA target site sequence
gtggagtggaattctatttctgg

SEQ ID NO: 692 - DNA, 23 bp, Artificial
  gRNA target site sequence
ttaatgctgattatgtggagtgg

SEQ ID NO: 693 - DNA, 23 bp, Artificial
  gRNA target site sequence
atggcttaatgctgattatgtgg

SEQ ID NO: 694 - DNA, 23 bp, Artificial
  gRNA target site sequence
tctccaaaccacatggtggatgg

SEQ ID NO: 695 - DNA, 23 bp, Artificial
  gRNA target site sequence
cctttctccaaaccacatggtgg

SEQ ID NO: 696 - DNA, 23 bp, Artificial
  gRNA target site sequence
gctcctttctccaaaccacatgg

SEQ ID NO: 697 - DNA, 23 bp, Artificial
  gRNA target site sequence
atgtatgtattatttgccttagg

SEQ ID NO: 698 - DNA, 23 bp, Artificial
  gRNA target site sequence
tgaataagctagacatgtttagg

SEQ ID NO: 699 - DNA, 23 bp, Artificial
  gRNA target site sequence
acactcagatccatgcatgccgg

SEQ ID NO: 700 - DNA, 23 bp, Artificial
  gRNA target site sequence
ccatgcatgccggcatcccaagg

SEQ ID NO: 701 - DNA, 23 bp, Artificial
  gRNA target site sequence
agcttattcacatgaacctaagg

SEQ ID NO: 702 - DNA, 23 bp, Artificial
  gRNA target site sequence
gtgagatgatgaaggatctcagg

SEQ ID NO: 703 - DNA, 23 bp, Artificial
  gRNA target site sequence
ggtctgttgtgagatgatgaagg

SEQ ID NO: 704 - DNA, 23 bp, Artificial
  gRNA target site sequence
atgcatggatctgagtgttgcgg

SEQ ID NO: 705 - DNA, 23 bp, Artificial
  gRNA target site sequence
ccttgggatgccggcatgcatgg

SEQ ID NO: 706 - DNA, 23 bp, Artificial
  gRNA target site sequence
gcacacgtaccttgggatgccgg

SEQ ID NO: 707 - DNA, 23 bp, Artificial
  gRNA target site sequence
atcacttgcacacgtaccttggg

SEQ ID NO: 708 - DNA, 23 bp, Artificial
  gRNA target site sequence
aatcacttgcacacgtaccttgg

SEQ ID NO: 709 - DNA, 23 bp, Artificial
  gRNA target site sequence
gtctctttaaaatcctgtctagg

SEQ ID NO: 710 - DNA, 23 bp, Artificial
  gRNA target site sequence
tctttaaaatcctgtctaggagg

SEQ ID NO: 711 - DNA, 23 bp, Artificial
  gRNA target site sequence
gtctaggaggagtgtttaagtgg

SEQ ID NO: 712 - DNA, 23 bp, Artificial
  gRNA target site sequence
tttaagtggagtcttagagctgg

SEQ ID NO: 713 - DNA, 23 bp, Artificial
  gRNA target site sequence
tcttagagctggtccgaagctgg

SEQ ID NO: 714 - DNA, 23 bp, Artificial
  gRNA target site sequence
tggtccgaagctggatcactcgg

SEQ ID NO: 715 - DNA, 23 bp, Artificial
  gRNA target site sequence
ggagcccgtaccatgttgtgtgg

SEQ ID NO: 716 - DNA, 23 bp, Artificial
  gRNA target site sequence
tgtgtggctgaactgcaaagcgg

SEQ ID NO: 717 - DNA, 23 bp, Artificial
  gRNA target site sequence
ctgaactgcaaagcggcttatgg

SEQ ID NO: 718 - DNA, 23 bp, Artificial
  gRNA target site sequence
accaaccttagtgaagaattagg

SEQ ID NO: 719 - DNA, 23 bp, Artificial
  gRNA target site sequence
tagtgaagaattaggagtccagg

SEQ ID NO: 720 - DNA, 23 bp, Artificial
  gRNA target site sequence
aagaattaggagtccaggtatgg

SEQ ID NO: 721 - DNA, 23 bp, Artificial
  gRNA target site sequence
cttaaacactcctcctagacagg

SEQ ID NO: 722 - DNA, 23 bp, Artificial
  gRNA target site sequence
ggctccgagtgatccagcttcgg

SEQ ID NO: 723 - DNA, 23 bp, Artificial
  gRNA target site sequence
tcagccacacaacatggtacggg

SEQ ID NO: 724 - DNA, 23 bp, Artificial
  gRNA target site sequence
ttcagccacacaacatggtacgg

SEQ ID NO: 725 - DNA, 23 bp, Artificial
  gRNA target site sequence
tgcagttcagccacacaacatgg

SEQ ID NO: 726 - DNA, 23 bp, Artificial
  gRNA target site sequence
tcctaattcttcactaaggttgg

SEQ ID NO: 727 - DNA, 23 bp, Artificial
  gRNA target site sequence
ggactcctaattcttcactaagg

SEQ ID NO: 728 - DNA, 23 bp, Artificial
  gRNA target site sequence
gaatgaacagtcaccatacctgg

SEQ ID NO: 729 - DNA, 23 bp, Artificial
  gRNA target site sequence
agacatccaaagtgtatatttgg

SEQ ID NO: 730 - DNA, 23 bp, Artificial
  gRNA target site sequence
gattttaccaaattccaagtcgg

SEQ ID NO: 731 - DNA, 23 bp, Artificial
  gRNA target site sequence
attttaccaaattccaagtcggg

SEQ ID NO: 732 - DNA, 23 bp, Artificial
  gRNA target site sequence
ccaagtcgggtaagtctgcctgg

SEQ ID NO: 733 - DNA, 23 bp, Artificial
  gRNA target site sequence
agtcgggtaagtctgcctggagg

SEQ ID NO: 734 - DNA, 23 bp, Artificial
  gRNA target site sequence
gtaagtctgcctggaggaacagg

SEQ ID NO: 735 - DNA, 23 bp, Artificial
  gRNA target site sequence
taagtctgcctggaggaacaggg

SEQ ID NO: 736 - DNA, 23 bp, Artificial
  gRNA target site sequence
tagtatccaaatatacactttgg

SEQ ID NO: 737 - DNA, 23 bp, Artificial
  gRNA target site sequence
cttggaatttggtaaaatcttgg

SEQ ID NO: 738 - DNA, 23 bp, Artificial
  gRNA target site sequence
gacttacccgacttggaatttgg

SEQ ID NO: 739 - DNA, 23 bp, Artificial
  gRNA target site sequence
ccaggcagacttacccgacttgg

SEQ ID NO: 740 - DNA, 23 bp, Artificial
  gRNA target site sequence
ctgggatatatttctttttcagg

SEQ ID NO: 741 - DNA, 23 bp, Artificial
  gRNA target site sequence
ctttttcaggtttttatttcagg

SEQ ID NO: 742 - DNA, 23 bp, Artificial
  gRNA target site sequence
tttttcaggtttttatttcaggg

SEQ ID NO: 743 - DNA, 23 bp, Artificial
  gRNA target site sequence
tttttatttcagggcaataatgg

SEQ ID NO: 744 - DNA, 23 bp, Artificial
  gRNA target site sequence
aatggaactgtcctgtacacagg

SEQ ID NO: 745 - DNA, 23 bp, Artificial
  gRNA target site sequence
gtacacaggagacttcagattgg

SEQ ID NO: 746 - DNA, 23 bp, Artificial
  gRNA target site sequence
ggagacttcagattggcgcaagg

SEQ ID NO: 747 - DNA, 23 bp, Artificial
  gRNA target site sequence
gcaaggagaagctgctagaatgg

SEQ ID NO: 748 - DNA, 23 bp, Artificial
  gRNA target site sequence
agaatggagcttctgcactccgg

SEQ ID NO: 749 - DNA, 23 bp, Artificial
  gRNA target site sequence
gaatggagcttctgcactccggg

SEQ ID NO: 750 - DNA, 23 bp, Artificial
  gRNA target site sequence
aatggagcttctgcactccgggg

SEQ ID NO: 751 - DNA, 23 bp, Artificial
  gRNA target site sequence
atggagcttctgcactccggggg

SEQ ID NO: 752 - DNA, 23 bp, Artificial
  gRNA target site sequence
agcttctgcactccgggggcagg

SEQ ID NO: 753 - DNA, 23 bp, Artificial
  gRNA target site sequence
tgcactccgggggcaggtactgg

SEQ ID NO: 754 - DNA, 23 bp, Artificial
  gRNA target site sequence
gcactccgggggcaggtactggg

SEQ ID NO: 755 - DNA, 23 bp, Artificial
  gRNA target site sequence
gcaggtactgggcctcgtatagg

SEQ ID NO: 756 - DNA, 23 bp, Artificial
  gRNA target site sequence
atctgaagtctcctgtgtacagg

SEQ ID NO: 757 - DNA, 23 bp, Artificial
  gRNA target site sequence
cgaggcccagtacctgcccccgg

SEQ ID NO: 758 - DNA, 23 bp, Artificial
  gRNA target site sequence
ttctttattttctttttagaagg

SEQ ID NO: 759 - DNA, 23 bp, Artificial
  gRNA target site sequence
gttgtgactctcttaccagctgg

SEQ ID NO: 760 - DNA, 23 bp, Artificial
  gRNA target site sequence
cttaccagctggtcactgtccgg

SEQ ID NO: 761 - DNA, 23 bp, Artificial
  gRNA target site sequence
ttaccagctggtcactgtccggg

SEQ ID NO: 762 - DNA, 23 bp, Artificial
  gRNA target site sequence
tgtccgggatcagttatgtaagg

SEQ ID NO: 763 - DNA, 23 bp, Artificial
  gRNA target site sequence
gtccgggatcagttatgtaaggg

SEQ ID NO: 764 - DNA, 23 bp, Artificial
  gRNA target site sequence
tccgggatcagttatgtaagggg

SEQ ID NO: 765 - DNA, 23 bp, Artificial
  gRNA target site sequence
ccgggatcagttatgtaaggggg

SEQ ID NO: 766 - DNA, 23 bp, Artificial
  gRNA target site sequence
gatcccggacagtgaccagctgg

SEQ ID NO: 767 - DNA, 23 bp, Artificial
  gRNA target site sequence
cccccttacataactgatcccgg

SEQ ID NO: 768 - DNA, 23 bp, Artificial
  gRNA target site sequence
tcctacccagatatctttagtgg

SEQ ID NO: 769 - DNA, 23 bp, Artificial
  gRNA target site sequence
tctttagtggatgaagcatcagg

SEQ ID NO: 770 - DNA, 23 bp, Artificial
  gRNA target site sequence
agtggatgaagcatcaggagagg

SEQ ID NO: 771 - DNA, 23 bp, Artificial
  gRNA target site sequence
tccactaaagatatctgggtagg

SEQ ID NO: 772 - DNA, 23 bp, Artificial
  gRNA target site sequence
ttcatccactaaagatatctggg

SEQ ID NO: 773 - DNA, 23 bp, Artificial
  gRNA target site sequence
cttcatccactaaagatatctgg

SEQ ID NO: 774 - DNA, 23 bp, Artificial
  gRNA target site sequence
cttttttcctttcagcttgaagg

SEQ ID NO: 775 - DNA, 23 bp, Artificial
  gRNA target site sequence
atactgttcacctgtgactaagg

SEQ ID NO: 776 - DNA, 23 bp, Artificial
  gRNA target site sequence
cgagcccgaaatacagattttgg

SEQ ID NO: 777 - DNA, 23 bp, Artificial
  gRNA target site sequence
agataaaccttcaagctgaaagg

SEQ ID NO: 778 - DNA, 23 bp, Artificial
  gRNA target site sequence
aacaacaactccttagtcacagg

SEQ ID NO: 779 - DNA, 23 bp, Artificial
  gRNA target site sequence
tcttccaaaatctgtatttcggg

SEQ ID NO: 780 - DNA, 23 bp, Artificial
  gRNA target site sequence
ttcttccaaaatctgtatttcgg

SEQ ID NO: 781 - DNA, 23 bp, Artificial
  gRNA target site sequence
ttgtttttagatcacatgaaagg

SEQ ID NO: 782 - DNA, 23 bp, Artificial
  gRNA target site sequence
gagcccctaccttgaaaagaagg

SEQ ID NO: 783 - DNA, 23 bp, Artificial
  gRNA target site sequence
ccctaccttgaaaagaaggttgg

SEQ ID NO: 784 - DNA, 23 bp, Artificial
  gRNA target site sequence
tgaaaagaaggttggagtgcagg

SEQ ID NO: 785 - DNA, 23 bp, Artificial
  gRNA target site sequence
caaccttcttttcaaggtagggg

SEQ ID NO: 786 - DNA, 23 bp, Artificial
  gRNA target site sequence
ccaaccttcttttcaaggtaggg

SEQ ID NO: 787 - DNA, 23 bp, Artificial
  gRNA target site sequence
tccaaccttcttttcaaggtagg

SEQ ID NO: 788 - DNA, 23 bp, Artificial
  gRNA target site sequence
gcactccaaccttcttttcaagg

SEQ ID NO: 789 - DNA, 23 bp, Artificial
  gRNA target site sequence
cggcgctatgagttctttcgagg

SEQ ID NO: 790 - DNA, 23 bp, Artificial
  gRNA target site sequence
ggcgctatgagttctttcgaggg

SEQ ID NO: 791 - DNA, 23 bp, Artificial
  gRNA target site sequence
gcgctatgagttctttcgagggg

SEQ ID NO: 792 - DNA, 23 bp, Artificial
  gRNA target site sequence
gagttctttcgaggggcagatgg

SEQ ID NO: 793 - DNA, 23 bp, Artificial
  gRNA target site sequence
tctccatagaccgcttcgatagg

SEQ ID NO: 794 - DNA, 23 bp, Artificial
  gRNA target site sequence
ctccatagaccgcttcgataggg

SEQ ID NO: 795 - DNA, 23 bp, Artificial
  gRNA target site sequence
gcttcgatagggagaacctgagg

SEQ ID NO: 796 - DNA, 23 bp, Artificial
  gRNA target site sequence
cttcgatagggagaacctgaggg

SEQ ID NO: 797 - DNA, 23 bp, Artificial
  gRNA target site sequence
ttcctgtcccactgccacaaagg

SEQ ID NO: 798 - DNA, 23 bp, Artificial
  gRNA target site sequence
cactgccacaaaggtgagtgagg

SEQ ID NO: 799 - DNA, 23 bp, Artificial
  gRNA target site sequence
actgccacaaaggtgagtgaggg

SEQ ID NO: 800 - DNA, 23 bp, Artificial
  gRNA target site sequence
cgccgccgatcccagagtccggg

SEQ ID NO: 801 - DNA, 23 bp, Artificial
  gRNA target site sequence
gcgccgccgatcccagagtccgg

SEQ ID NO: 802 - DNA, 23 bp, Artificial
  gRNA target site sequence
tatggagatagttggatactcgg

SEQ ID NO: 803 - DNA, 23 bp, Artificial
  gRNA target site sequence
aagcggtctatggagatagttgg

SEQ ID NO: 804 - DNA, 23 bp, Artificial
  gRNA target site sequence
ctccctatcgaagcggtctatgg

SEQ ID NO: 805 - DNA, 23 bp, Artificial
  gRNA target site sequence
tcaggttctccctatcgaagcgg

SEQ ID NO: 806 - DNA, 23 bp, Artificial
  gRNA target site sequence
ggaagtaggcgcgggccctcagg

SEQ ID NO: 807 - DNA, 23 bp, Artificial
  gRNA target site sequence
gtgggacaggaagtaggcgcggg

SEQ ID NO: 808 - DNA, 23 bp, Artificial
  gRNA target site sequence
agtgggacaggaagtaggcgcgg

SEQ ID NO: 809 - DNA, 23 bp, Artificial
  gRNA target site sequence
gtggcagtgggacaggaagtagg

SEQ ID NO: 810 - DNA, 23 bp, Artificial
  gRNA target site sequence
cacctttgtggcagtgggacagg

SEQ ID NO: 811 - DNA, 23 bp, Artificial
  gRNA target site sequence
tcactcacctttgtggcagtggg

SEQ ID NO: 812 - DNA, 23 bp, Artificial
  gRNA target site sequence
ctcactcacctttgtggcagtgg

SEQ ID NO: 813 - DNA, 23 bp, Artificial
  gRNA target site sequence
gcagccctcactcacctttgtgg

SEQ ID NO: 814 - DNA, 23 bp, Artificial
  gRNA target site sequence
tatcttcctcccacagctcctgg

SEQ ID NO: 815 - DNA, 23 bp, Artificial
  gRNA target site sequence
atcttcctcccacagctcctggg

SEQ ID NO: 816 - DNA, 23 bp, Artificial
  gRNA target site sequence
acagctcctgggcaacgtgctgg

SEQ ID NO: 817 - DNA, 23 bp, Artificial
  gRNA target site sequence
caacgtgctggtctgtgtgctgg

SEQ ID NO: 818 - DNA, 23 bp, Artificial
  gRNA target site sequence
tgtgtgctggcccatcactttgg

SEQ ID NO: 819 - DNA, 23 bp, Artificial
  gRNA target site sequence
agaattcaccccaccagtgcagg

SEQ ID NO: 820 - DNA, 23 bp, Artificial
  gRNA target site sequence
gcaggctgcctatcagaaagtgg

SEQ ID NO: 821 - DNA, 23 bp, Artificial
  gRNA target site sequence
ggctgcctatcagaaagtggtgg

SEQ ID NO: 822 - DNA, 23 bp, Artificial
  gRNA target site sequence
gcctatcagaaagtggtggctgg

SEQ ID NO: 823 - DNA, 23 bp, Artificial
  gRNA target site sequence
tcagaaagtggtggctggtgtgg

SEQ ID NO: 824 - DNA, 23 bp, Artificial
  gRNA target site sequence
ggctggtgtggctaatgccctgg

SEQ ID NO: 825 - DNA, 23 bp, Artificial
  gRNA target site sequence
agctgtgggaggaagataagagg

SEQ ID NO: 826 - DNA, 23 bp, Artificial
  gRNA target site sequence
cgttgcccaggagctgtgggagg

SEQ ID NO: 827 - DNA, 23 bp, Artificial
  gRNA target site sequence
gcacgttgcccaggagctgtggg

SEQ ID NO: 828 - DNA, 23 bp, Artificial
  gRNA target site sequence
agcacgttgcccaggagctgtgg

SEQ ID NO: 829 - DNA, 23 bp, Artificial
  gRNA target site sequence
cacagaccagcacgttgcccagg

SEQ ID NO: 830 - DNA, 23 bp, Artificial
  gRNA target site sequence
gaattctttgccaaagtgatggg

SEQ ID NO: 831 - DNA, 23 bp, Artificial
  gRNA target site sequence
tgaattctttgccaaagtgatgg

SEQ ID NO: 832 - DNA, 23 bp, Artificial
  gRNA target site sequence
ataggcagcctgcactggtgggg

SEQ ID NO: 833 - DNA, 23 bp, Artificial
  gRNA target site sequence
gataggcagcctgcactggtggg

SEQ ID NO: 834 - DNA, 23 bp, Artificial
  gRNA target site sequence
tgataggcagcctgcactggtgg

SEQ ID NO: 835 - DNA, 23 bp, Artificial
  gRNA target site sequence
ttctgataggcagcctgcactgg

SEQ ID NO: 836 - DNA, 23 bp, Artificial
  gRNA target site sequence
accagccaccactttctgatagg

SEQ ID NO: 837 - DNA, 23 bp, Artificial
  gRNA target site sequence
ttagtgatacttgtgggccaggg

SEQ ID NO: 838 - DNA, 23 bp, Artificial
  gRNA target site sequence
cttagtgatacttgtgggccagg

SEQ ID NO: 839 - DNA, 23 bp, Artificial
  gRNA target site sequence
gcgagcttagtgatacttgtggg

SEQ ID NO: 840 - DNA, 23 bp, Artificial
  gRNA target site sequence
agcgagcttagtgatacttgtgg

SEQ ID NO: 841 - DNA, 23 bp, Artificial
  gRNA target site sequence
tggtctattttcccacccttagg

SEQ ID NO: 842 - DNA, 23 bp, Artificial
  gRNA target site sequence
ttttcccacccttaggctgctgg

SEQ ID NO: 843 - DNA, 23 bp, Artificial
  gRNA target site sequence
tcccacccttaggctgctggtgg

SEQ ID NO: 844 - DNA, 23 bp, Artificial
  gRNA target site sequence
ggctgctggtggtctacccttgg

SEQ ID NO: 845 - DNA, 23 bp, Artificial
  gRNA target site sequence
tggtctacccttggacccagagg

SEQ ID NO: 846 - DNA, 23 bp, Artificial
  gRNA target site sequence
cagaggttctttgagtcctttgg

SEQ ID NO: 847 - DNA, 23 bp, Artificial
  gRNA target site sequence
agaggttctttgagtcctttggg

SEQ ID NO: 848 - DNA, 23 bp, Artificial
  gRNA target site sequence
gaggttctttgagtcctttgggg

SEQ ID NO: 849 - DNA, 23 bp, Artificial
  gRNA target site sequence
gtccactcctgatgctgttatgg

SEQ ID NO: 850 - DNA, 23 bp, Artificial
  gRNA target site sequence
tccactcctgatgctgttatggg

SEQ ID NO: 851 - DNA, 23 bp, Artificial
  gRNA target site sequence
tgctgttatgggcaaccctaagg

SEQ ID NO: 852 - DNA, 23 bp, Artificial
  gRNA target site sequence
tatgggcaaccctaaggtgaagg

SEQ ID NO: 853 - DNA, 23 bp, Artificial
  gRNA target site sequence
aaccctaaggtgaaggctcatgg

SEQ ID NO: 854 - DNA, 23 bp, Artificial
  gRNA target site sequence
gctcatggcaagaaagtgctcgg

SEQ ID NO: 855 - DNA, 23 bp, Artificial
  gRNA target site sequence
gtgctcggtgcctttagtgatgg

SEQ ID NO: 856 - DNA, 23 bp, Artificial
  gRNA target site sequence
cggtgcctttagtgatggcctgg

SEQ ID NO: 857 - DNA, 23 bp, Artificial
  gRNA target site sequence
tagtgatggcctggctcacctgg

SEQ ID NO: 858 - DNA, 23 bp, Artificial
  gRNA target site sequence
ggctcacctggacaacctcaagg

SEQ ID NO: 859 - DNA, 23 bp, Artificial
  gRNA target site sequence
gctcacctggacaacctcaaggg

SEQ ID NO: 860 - DNA, 23 bp, Artificial
  gRNA target site sequence
gcactgtgacaagctgcacgtgg

SEQ ID NO: 861 - DNA, 23 bp, Artificial
  gRNA target site sequence
acgtggatcctgagaacttcagg

SEQ ID NO: 862 - DNA, 23 bp, Artificial
  gRNA target site sequence
cgtggatcctgagaacttcaggg

SEQ ID NO: 863 - DNA, 23 bp, Artificial
  gRNA target site sequence
agaacttcagggtgagtctatgg

SEQ ID NO: 864 - DNA, 23 bp, Artificial
  gRNA target site sequence
gaacttcagggtgagtctatggg

SEQ ID NO: 865 - DNA, 23 bp, Artificial
  gRNA target site sequence
accaccagcagcctaagggtggg

SEQ ID NO: 866 - DNA, 23 bp, Artificial
  gRNA target site sequence
gaccaccagcagcctaagggtgg

SEQ ID NO: 867 - DNA, 23 bp, Artificial
  gRNA target site sequence
gtagaccaccagcagcctaaggg

SEQ ID NO: 868 - DNA, 23 bp, Artificial
  gRNA target site sequence
ggtagaccaccagcagcctaagg

SEQ ID NO: 869 - DNA, 23 bp, Artificial
  gRNA target site sequence
caaagaacctctgggtccaaggg

SEQ ID NO: 870 - DNA, 23 bp, Artificial
  gRNA target site sequence
tcaaagaacctctgggtccaagg

SEQ ID NO: 871 - DNA, 23 bp, Artificial
  gRNA target site sequence
aaaggactcaaagaacctctggg

SEQ ID NO: 872 - DNA, 23 bp, Artificial
  gRNA target site sequence
caaaggactcaaagaacctctgg

SEQ ID NO: 873 - DNA, 23 bp, Artificial
  gRNA target site sequence
aggagtggacagatccccaaagg

SEQ ID NO: 874 - DNA, 23 bp, Artificial
  gRNA target site sequence
gcccataacagcatcaggagtgg

SEQ ID NO: 875 - DNA, 23 bp, Artificial
  gRNA target site sequence
gggttgcccataacagcatcagg

SEQ ID NO: 876 - DNA, 23 bp, Artificial
  gRNA target site sequence
tgccatgagccttcaccttaggg

SEQ ID NO: 877 - DNA, 23 bp, Artificial
  gRNA target site sequence
ttgccatgagccttcaccttagg

SEQ ID NO: 878 - DNA, 23 bp, Artificial
  gRNA target site sequence
gtgagccaggccatcactaaagg

SEQ ID NO: 879 - DNA, 23 bp, Artificial
  gRNA target site sequence
tgaggttgtccaggtgagccagg

SEQ ID NO: 880 - DNA, 23 bp, Artificial
  gRNA target site sequence
aggtgcccttgaggttgtccagg

SEQ ID NO: 881 - DNA, 23 bp, Artificial
  gRNA target site sequence
gtgtggcaaaggtgcccttgagg

SEQ ID NO: 882 - DNA, 23 bp, Artificial
  gRNA target site sequence
cagctcactcagtgtggcaaagg

SEQ ID NO: 883 - DNA, 23 bp, Artificial
  gRNA target site sequence
acagtgcagctcactcagtgtgg

SEQ ID NO: 884 - DNA, 23 bp, Artificial
  gRNA target site sequence
agactcaccctgaagttctcagg

SEQ ID NO: 885 - DNA, 23 bp, Artificial
  gRNA target site sequence
gcaacctcaaacagacaccatgg

SEQ ID NO: 886 - DNA, 23 bp, Artificial
  gRNA target site sequence
catggtgcatctgactcctgagg

SEQ ID NO: 887 - DNA, 23 bp, Artificial
  gRNA target site sequence
agtctgccgttactgccctgtgg

SEQ ID NO: 888 - DNA, 23 bp, Artificial
  gRNA target site sequence
gtctgccgttactgccctgtggg

SEQ ID NO: 889 - DNA, 23 bp, Artificial
  gRNA target site sequence
tctgccgttactgccctgtgggg

SEQ ID NO: 890 - DNA, 23 bp, Artificial
  gRNA target site sequence
cgttactgccctgtggggcaagg

SEQ ID NO: 891 - DNA, 23 bp, Artificial
  gRNA target site sequence
cctgtggggcaaggtgaacgtgg

SEQ ID NO: 892 - DNA, 23 bp, Artificial
  gRNA target site sequence
aaggtgaacgtggatgaagttgg

SEQ ID NO: 893 - DNA, 23 bp, Artificial
  gRNA target site sequence
gtgaacgtggatgaagttggtgg

SEQ ID NO: 894 - DNA, 23 bp, Artificial
  gRNA target site sequence
cgtggatgaagttggtggtgagg

SEQ ID NO: 895 - DNA, 23 bp, Artificial
  gRNA target site sequence
tgaagttggtggtgaggccctgg

SEQ ID NO: 896 - DNA, 23 bp, Artificial
  gRNA target site sequence
gaagttggtggtgaggccctggg

SEQ ID NO: 897 - DNA, 23 bp, Artificial
  gRNA target site sequence
ttggtggtgaggccctgggcagg

SEQ ID NO: 898 - DNA, 23 bp, Artificial
  gRNA target site sequence
tggtgaggccctgggcaggttgg

SEQ ID NO: 899 - DNA, 23 bp, Artificial
  gRNA target site sequence
ccctgggcaggttggtatcaagg

SEQ ID NO: 900 - DNA, 23 bp, Artificial
  gRNA target site sequence
tggtatcaaggttacaagacagg

SEQ ID NO: 901 - DNA, 23 bp, Artificial
  gRNA target site sequence
tgcaccatggtgtctgtttgagg

SEQ ID NO: 902 - DNA, 23 bp, Artificial
  gRNA target site sequence
ctcaggagtcagatgcaccatgg

SEQ ID NO: 903 - DNA, 23 bp, Artificial
  gRNA target site sequence
gtaacggcagacttctcctcagg

SEQ ID NO: 904 - DNA, 23 bp, Artificial
  gRNA target site sequence
cttgccccacagggcagtaacgg

SEQ ID NO: 905 - DNA, 23 bp, Artificial
  gRNA target site sequence
cacgttcaccttgccccacaggg

SEQ ID NO: 906 - DNA, 23 bp, Artificial
  gRNA target site sequence
ccacgttcaccttgccccacagg

SEQ ID NO: 907 - DNA, 23 bp, Artificial
  gRNA target site sequence
ccttgataccaacctgcccaggg

SEQ ID NO: 908 - DNA, 23 bp, Artificial
  gRNA target site sequence
accttgataccaacctgcccagg

SEQ ID NO: 909 - DNA, 23 bp, Artificial
  gRNA target site sequence
acctggacatatctgtctttagg

SEQ ID NO: 910 - DNA, 23 bp, Artificial
  gRNA target site sequence
gacatatctgtctttaggcctgg

SEQ ID NO: 911 - DNA, 23 bp, Artificial
  gRNA target site sequence
atctgtctttaggcctggagtgg

SEQ ID NO: 912 - DNA, 23 bp, Artificial
  gRNA target site sequence
ggcctggagtggtgtgtctaagg

SEQ ID NO: 913 - DNA, 23 bp, Artificial
  gRNA target site sequence
gcctggagtggtgtgtctaaggg

SEQ ID NO: 914 - DNA, 23 bp, Artificial
  gRNA target site sequence
gagtggtgtgtctaagggactgg

SEQ ID NO: 915 - DNA, 23 bp, Artificial
  gRNA target site sequence
gtcagtgagattcccccaaaagg

SEQ ID NO: 916 - DNA, 23 bp, Artificial
  gRNA target site sequence
agtgagattcccccaaaaggagg

SEQ ID NO: 917 - DNA, 23 bp, Artificial
  gRNA target site sequence
gtgagattcccccaaaaggaggg

SEQ ID NO: 918 - DNA, 23 bp, Artificial
  gRNA target site sequence
tgagattcccccaaaaggagggg

SEQ ID NO: 919 - DNA, 23 bp, Artificial
  gRNA target site sequence
cccccaaaaggaggggcccttgg

SEQ ID NO: 920 - DNA, 23 bp, Artificial
  gRNA target site sequence
ccccaaaaggaggggcccttggg

SEQ ID NO: 921 - DNA, 23 bp, Artificial
  gRNA target site sequence
cccaaaaggaggggcccttgggg

SEQ ID NO: 922 - DNA, 23 bp, Artificial
  gRNA target site sequence
aaaaggaggggcccttggggagg

SEQ ID NO: 923 - DNA, 23 bp, Artificial
  gRNA target site sequence
aaaggaggggcccttggggaggg

SEQ ID NO: 924 - DNA, 23 bp, Artificial
  gRNA target site sequence
aaggaggggcccttggggagggg

SEQ ID NO: 925 - DNA, 23 bp, Artificial
  gRNA target site sequence
ggggcccttggggaggggcctgg

SEQ ID NO: 926 - DNA, 23 bp, Artificial
  gRNA target site sequence
gggcccttggggaggggcctggg

SEQ ID NO: 927 - DNA, 23 bp, Artificial
  gRNA target site sequence
ggcccttggggaggggcctgggg

SEQ ID NO: 928 - DNA, 23 bp, Artificial
  gRNA target site sequence
gcaaccagcatagcccctactgg

SEQ ID NO: 929 - DNA, 23 bp, Artificial
  gRNA target site sequence
caaccagcatagcccctactggg

SEQ ID NO: 930 - DNA, 23 bp, Artificial
  gRNA target site sequence
gcctaaagacagatatgtccagg

SEQ ID NO: 931 - DNA, 23 bp, Artificial
  gRNA target site sequence
tcccttagacacaccactccagg

SEQ ID NO: 932 - DNA, 23 bp, Artificial
  gRNA target site sequence
cagagtcgttcactgtagtctgg

SEQ ID NO: 933 - DNA, 23 bp, Artificial
  gRNA target site sequence
ttgggggaatctcactgacgagg

SEQ ID NO: 934 - DNA, 23 bp, Artificial
  gRNA target site sequence
ccaagggcccctccttttggggg

SEQ ID NO: 935 - DNA, 23 bp, Artificial
  gRNA target site sequence
cccaagggcccctccttttgggg

SEQ ID NO: 936 - DNA, 23 bp, Artificial
  gRNA target site sequence
ccccaagggcccctccttttggg

SEQ ID NO: 937 - DNA, 23 bp, Artificial
  gRNA target site sequence
tccccaagggcccctccttttgg

SEQ ID NO: 938 - DNA, 23 bp, Artificial
  gRNA target site sequence
ggccccaggcccctccccaaggg

SEQ ID NO: 939 - DNA, 23 bp, Artificial
  gRNA target site sequence
aggccccaggcccctccccaagg

SEQ ID NO: 940 - DNA, 23 bp, Artificial
  gRNA target site sequence
tggttgcatggggaggccccagg

SEQ ID NO: 941 - DNA, 23 bp, Artificial
  gRNA target site sequence
gctatgctggttgcatggggagg

SEQ ID NO: 942 - DNA, 23 bp, Artificial
  gRNA target site sequence
ggggctatgctggttgcatgggg

SEQ ID NO: 943 - DNA, 23 bp, Artificial
  gRNA target site sequence
aggggctatgctggttgcatggg

SEQ ID NO: 944 - DNA, 23 bp, Artificial
  gRNA target site sequence
taggggctatgctggttgcatgg

SEQ ID NO: 945 - DNA, 23 bp, Artificial
  gRNA target site sequence
gggcccagtaggggctatgctgg

SEQ ID NO: 946 - DNA, 23 bp, Artificial
  gRNA target site sequence
aacatgggggggcccagtagggg

SEQ ID NO: 947 - DNA, 23 bp, Artificial
  gRNA target site sequence
taacatgggggggcccagtaggg

SEQ ID NO: 948 - DNA, 23 bp, Artificial
  gRNA target site sequence
gtaacatgggggggcccagtagg

SEQ ID NO: 949 - DNA, 23 bp, Artificial
  gRNA target site sequence
ctttagggtgtaacatggggggg

SEQ ID NO: 950 - DNA, 23 bp, Artificial
  gRNA target site sequence
gctttagggtgtaacatgggggg

SEQ ID NO: 951 - DNA, 23 bp, Artificial
  gRNA target site sequence
ggctttagggtgtaacatggggg

SEQ ID NO: 952 - DNA, 23 bp, Artificial
  gRNA target site sequence
aggctttagggtgtaacatgggg

SEQ ID NO: 953 - DNA, 23 bp, Artificial
  gRNA target site sequence
caggctttagggtgtaacatggg

SEQ ID NO: 954 - DNA, 23 bp, Artificial
  gRNA target site sequence
tcaggctttagggtgtaacatgg

SEQ ID NO: 955 - DNA, 23 bp, Artificial
  gRNA target site sequence
ggttcaggtttcaggctttaggg

SEQ ID NO: 956 - DNA, 23 bp, Artificial
  gRNA target site sequence
gggttcaggtttcaggctttagg

SEQ ID NO: 957 - DNA, 23 bp, Artificial
  gRNA target site sequence
aggattggggttcaggtttcagg

SEQ ID NO: 958 - DNA, 23 bp, Artificial
  gRNA target site sequence
ctgtcagaggattggggttcagg

SEQ ID NO: 959 - DNA, 23 bp, Artificial
  gRNA target site sequence
gttcttctgtcagaggattgggg

SEQ ID NO: 960 - DNA, 23 bp, Artificial
  gRNA target site sequence
ggttcttctgtcagaggattggg

SEQ ID NO: 961 - DNA, 23 bp, Artificial
  gRNA target site sequence
ctccctctttctcccctgtcagg

SEQ ID NO: 962 - DNA, 23 bp, Artificial
  gRNA target site sequence
tcccaccctgaagaacctagagg

SEQ ID NO: 963 - DNA, 23 bp, Artificial
  gRNA target site sequence
gatcttgttactgaataccacgg

SEQ ID NO: 964 - DNA, 23 bp, Artificial
  gRNA target site sequence
atcttgttactgaataccacggg

SEQ ID NO: 965 - DNA, 23 bp, Artificial
  gRNA target site sequence
tgaataccacgggaacttttcgg

SEQ ID NO: 966 - DNA, 23 bp, Artificial
  gRNA target site sequence
gtcctgacaggggagaaagaggg

SEQ ID NO: 967 - DNA, 23 bp, Artificial
  gRNA target site sequence
cgtcctgacaggggagaaagagg

SEQ ID NO: 968 - DNA, 23 bp, Artificial
  gRNA target site sequence
tcggggcatcgtcctgacagggg

SEQ ID NO: 969 - DNA, 23 bp, Artificial
  gRNA target site sequence
ttcggggcatcgtcctgacaggg

SEQ ID NO: 970 - DNA, 23 bp, Artificial
  gRNA target site sequence
attcggggcatcgtcctgacagg

SEQ ID NO: 971 - DNA, 23 bp, Artificial
  gRNA target site sequence
ttcttcagggtgggaattcgggg

SEQ ID NO: 972 - DNA, 23 bp, Artificial
  gRNA target site sequence
gttcttcagggtgggaattcggg

SEQ ID NO: 973 - DNA, 23 bp, Artificial
  gRNA target site sequence
ggttcttcagggtgggaattcgg

SEQ ID NO: 974 - DNA, 23 bp, Artificial
  gRNA target site sequence
tcctctaggttcttcagggtggg

SEQ ID NO: 975 - DNA, 23 bp, Artificial
  gRNA target site sequence
atcctctaggttcttcagggtgg

SEQ ID NO: 976 - DNA, 23 bp, Artificial
  gRNA target site sequence
aagatcctctaggttcttcaggg

SEQ ID NO: 977 - DNA, 23 bp, Artificial
  gRNA target site sequence
caagatcctctaggttcttcagg

SEQ ID NO: 978 - DNA, 23 bp, Artificial
  gRNA target site sequence
attcagtaacaagatcctctagg

SEQ ID NO: 979 - DNA, 23 bp, Artificial
  gRNA target site sequence
ttctcaccgaaaagttcccgtgg

SEQ ID NO: 980 - DNA, 23 bp, Artificial
  gRNA target site sequence
gaatcctttcctgtttgcattgg

SEQ ID NO: 981 - DNA, 23 bp, Artificial
  gRNA target site sequence
cctgtttgcattggaagccgtgg

SEQ ID NO: 982 - DNA, 23 bp, Artificial
  gRNA target site sequence
gaagccgtggttatctctgttgg

SEQ ID NO: 983 - DNA, 23 bp, Artificial
  gRNA target site sequence
ggttatctctgttggctccatgg

SEQ ID NO: 984 - DNA, 23 bp, Artificial
  gRNA target site sequence
gttatctctgttggctccatggg

SEQ ID NO: 985 - DNA, 23 bp, Artificial
  gRNA target site sequence
gccttctctgtgtgtatttctgg

SEQ ID NO: 986 - DNA, 23 bp, Artificial
  gRNA target site sequence
tctctgtgtgtatttctggctgg

SEQ ID NO: 987 - DNA, 23 bp, Artificial
  gRNA target site sequence
gtgtgtatttctggctggaacgg

SEQ ID NO: 988 - DNA, 23 bp, Artificial
  gRNA target site sequence
ctggctggaacggtgagatttgg

SEQ ID NO: 989 - DNA, 23 bp, Artificial
  gRNA target site sequence
gcttccaatgcaaacaggaaagg

SEQ ID NO: 990 - DNA, 23 bp, Artificial
  gRNA target site sequence
ccacggcttccaatgcaaacagg

SEQ ID NO: 991 - DNA, 23 bp, Artificial
  gRNA target site sequence
ggagccaacagagataaccacgg

SEQ ID NO: 992 - DNA, 23 bp, Artificial
  gRNA target site sequence
aaggctgataatcaatcccatgg

SEQ ID NO: 993 - DNA, 23 bp, Artificial
  gRNA target site sequence
gccagaaatacacacagagaagg

SEQ ID NO: 994 - DNA, 23 bp, Artificial
  gRNA target site sequence
cctcatcctctttctcctcaagg

SEQ ID NO: 995 - DNA, 23 bp, Artificial
  gRNA target site sequence
tctcctcaaggaacaatcagtgg

SEQ ID NO: 996 - DNA, 23 bp, Artificial
  gRNA target site sequence
taagttctccttgcctagtgtgg

SEQ ID NO: 997 - DNA, 23 bp, Artificial
  gRNA target site sequence
ttctccttgcctagtgtggatgg

SEQ ID NO: 998 - DNA, 23 bp, Artificial
  gRNA target site sequence
tctccttgcctagtgtggatggg

SEQ ID NO: 999 - DNA, 23 bp, Artificial
  gRNA target site sequence
aacgctacacgtttcgtgttcgg

SEQ ID NO: 1000 - DNA, 23 bp, Artificial
  gRNA target site sequence
agccgctttaacccactctgtgg

SEQ ID NO: 1001 - DNA, 23 bp, Artificial
  gRNA target site sequence
tctgtggaagtgctcagcattgg

SEQ ID NO: 1002 - DNA, 23 bp, Artificial
  gRNA target site sequence
gtgctcagcattggagtgaatgg

SEQ ID NO: 1003 - DNA, 23 bp, Artificial
  gRNA target site sequence
aatggagccacccaatccactgg

SEQ ID NO: 1004 - DNA, 23 bp, Artificial
  gRNA target site sequence
atggagccacccaatccactggg

SEQ ID NO: 1005 - DNA, 23 bp, Artificial
  gRNA target site sequence
tggagccacccaatccactgggg

SEQ ID NO: 1006 - DNA, 23 bp, Artificial
  gRNA target site sequence
ggagccacccaatccactggggg

SEQ ID NO: 1007 - DNA, 23 bp, Artificial
  gRNA target site sequence
tgggggagcaatacttcaaaagg

SEQ ID NO: 1008 - DNA, 23 bp, Artificial
  gRNA target site sequence
caatacttcaaaaggtaaaatgg

SEQ ID NO: 1009 - DNA, 23 bp, Artificial
  gRNA target site sequence
aatacttcaaaaggtaaaatggg

SEQ ID NO: 1010 - DNA, 23 bp, Artificial
  gRNA target site sequence
cttgaggagaaagaggatgaggg

SEQ ID NO: 1011 - DNA, 23 bp, Artificial
  gRNA target site sequence
ccttgaggagaaagaggatgagg

SEQ ID NO: 1012 - DNA, 23 bp, Artificial
  gRNA target site sequence
attgttccttgaggagaaagagg

SEQ ID NO: 1013 - DNA, 23 bp, Artificial
  gRNA target site sequence
aatccactgattgttccttgagg

SEQ ID NO: 1014 - DNA, 23 bp, Artificial
  gRNA target site sequence
ctgcccatccacactaggcaagg

SEQ ID NO: 1015 - DNA, 23 bp, Artificial
  gRNA target site sequence
cgtttctgcccatccacactagg

SEQ ID NO: 1016 - DNA, 23 bp, Artificial
  gRNA target site sequence
ttccacagagtgggttaaagcgg

SEQ ID NO: 1017 - DNA, 23 bp, Artificial
  gRNA target site sequence
gctgagcacttccacagagtggg

SEQ ID NO: 1018 - DNA, 23 bp, Artificial
  gRNA target site sequence
tgctgagcacttccacagagtgg

SEQ ID NO: 1019 - DNA, 23 bp, Artificial
  gRNA target site sequence
tgctcccccagtggattgggtgg

SEQ ID NO: 1020 - DNA, 23 bp, Artificial
  gRNA target site sequence
tattgctcccccagtggattggg

SEQ ID NO: 1021 - DNA, 23 bp, Artificial
  gRNA target site sequence
gtattgctcccccagtggattgg

SEQ ID NO: 1022 - DNA, 23 bp, Artificial
  gRNA target site sequence
ttgaagtattgctcccccagtgg

SEQ ID NO: 1023 - DNA, 23 bp, Artificial
  gRNA target site sequence
acatatctccagtgatcccctgg

SEQ ID NO: 1024 - DNA, 23 bp, Artificial
  gRNA target site sequence
catatctccagtgatcccctggg

SEQ ID NO: 1025 - DNA, 23 bp, Artificial
  gRNA target site sequence
aatcccagctagaactgaactgg

SEQ ID NO: 1026 - DNA, 23 bp, Artificial
  gRNA target site sequence
cagattcttgaaccactgtttgg

SEQ ID NO: 1027 - DNA, 23 bp, Artificial
  gRNA target site sequence
gaaccactgtttggagcacttgg

SEQ ID NO: 1028 - DNA, 23 bp, Artificial
  gRNA target site sequence
tggagcacttggtgcagtaccgg

SEQ ID NO: 1029 - DNA, 23 bp, Artificial
  gRNA target site sequence
tggtgcagtaccggactgactgg

SEQ ID NO: 1030 - DNA, 23 bp, Artificial
  gRNA target site sequence
ggtgcagtaccggactgactggg

SEQ ID NO: 1031 - DNA, 23 bp, Artificial
  gRNA target site sequence
ggactgactgggaccacagctgg

SEQ ID NO: 1032 - DNA, 23 bp, Artificial
  gRNA target site sequence
cagctggactgtgagtgactagg

SEQ ID NO: 1033 - DNA, 23 bp, Artificial
  gRNA target site sequence
agctggactgtgagtgactaggg

SEQ ID NO: 1034 - DNA, 23 bp, Artificial
  gRNA target site sequence
tggagatatgtgtgcatatgtgg

SEQ ID NO: 1035 - DNA, 23 bp, Artificial
  gRNA target site sequence
tctggagcccaggggatcactgg

SEQ ID NO: 1036 - DNA, 23 bp, Artificial
  gRNA target site sequence
ttaggttctctggagcccagggg

SEQ ID NO: 1037 - DNA, 23 bp, Artificial
  gRNA target site sequence
gttaggttctctggagcccaggg

SEQ ID NO: 1038 - DNA, 23 bp, Artificial
  gRNA target site sequence
tgttaggttctctggagcccagg

SEQ ID NO: 1039 - DNA, 23 bp, Artificial
  gRNA target site sequence
ttgtgaagtgttaggttctctgg

SEQ ID NO: 1040 - DNA, 23 bp, Artificial
  gRNA target site sequence
cactcagtttgtgaagtgttagg

SEQ ID NO: 1041 - DNA, 23 bp, Artificial
  gRNA target site sequence
gttccagttcagttctagctggg

SEQ ID NO: 1042 - DNA, 23 bp, Artificial
  gRNA target site sequence
tgttccagttcagttctagctgg

SEQ ID NO: 1043 - DNA, 23 bp, Artificial
  gRNA target site sequence
gcaccaagtgctccaaacagtgg

SEQ ID NO: 1044 - DNA, 23 bp, Artificial
  gRNA target site sequence
agctgtggtcccagtcagtccgg

SEQ ID NO: 1045 - DNA, 23 bp, Artificial
  gRNA target site sequence
agtcactcacagtccagctgtgg

SEQ ID NO: 1046 - DNA, 23 bp, Artificial
  gRNA target site sequence
ccttccaacctttctcctctagg

SEQ ID NO: 1047 - DNA, 23 bp, Artificial
  gRNA target site sequence
ctcctctaggtacaagaactcgg

SEQ ID NO: 1048 - DNA, 23 bp, Artificial
  gRNA target site sequence
ttctctgaagaaatcacttctgg

SEQ ID NO: 1049 - DNA, 23 bp, Artificial
  gRNA target site sequence
tggctgtcagttgcaaaaaaagg

SEQ ID NO: 1050 - DNA, 23 bp, Artificial
  gRNA target site sequence
aacatttgttgttcagctccagg

SEQ ID NO: 1051 - DNA, 23 bp, Artificial
  gRNA target site sequence
ttgttcagctccaggacccacgg

SEQ ID NO: 1052 - DNA, 23 bp, Artificial
  gRNA target site sequence
tgttcagctccaggacccacggg

SEQ ID NO: 1053 - DNA, 23 bp, Artificial
  gRNA target site sequence
tccaggacccacgggaacccagg

SEQ ID NO: 1054 - DNA, 23 bp, Artificial
  gRNA target site sequence
cccacgggaacccaggagacagg

SEQ ID NO: 1055 - DNA, 23 bp, Artificial
  gRNA target site sequence
gatgctaaaactgcagaatctgg

SEQ ID NO: 1056 - DNA, 23 bp, Artificial
  gRNA target site sequence
atgctaaaactgcagaatctggg

SEQ ID NO: 1057 - DNA, 23 bp, Artificial
  gRNA target site sequence
actgcagaatctgggtaatttgg

SEQ ID NO: 1058 - DNA, 23 bp, Artificial
  gRNA target site sequence
tctgggtaatttggaaagaaagg

SEQ ID NO: 1059 - DNA, 23 bp, Artificial
  gRNA target site sequence
ctgggtaatttggaaagaaaggg

SEQ ID NO: 1060 - DNA, 23 bp, Artificial
  gRNA target site sequence
cctagaggagaaaggttggaagg

SEQ ID NO: 1061 - DNA, 23 bp, Artificial
  gRNA target site sequence
tgtacctagaggagaaaggttgg

SEQ ID NO: 1062 - DNA, 23 bp, Artificial
  gRNA target site sequence
ttcttgtacctagaggagaaagg

SEQ ID NO: 1063 - DNA, 23 bp, Artificial
  gRNA target site sequence
atccgagttcttgtacctagagg

SEQ ID NO: 1064 - DNA, 23 bp, Artificial
  gRNA target site sequence
atagatagtggctgcacttctgg

SEQ ID NO: 1065 - DNA, 23 bp, Artificial
  gRNA target site sequence
tttcttcagagaatagatagtgg

SEQ ID NO: 1066 - DNA, 23 bp, Artificial
  gRNA target site sequence
caacaaatgtttggtagaggtgg

SEQ ID NO: 1067 - DNA, 23 bp, Artificial
  gRNA target site sequence
gaacaacaaatgtttggtagagg

SEQ ID NO: 1068 - DNA, 23 bp, Artificial
  gRNA target site sequence
ggagctgaacaacaaatgtttgg

SEQ ID NO: 1069 - DNA, 23 bp, Artificial
  gRNA target site sequence
tcctgggttcccgtgggtcctgg

SEQ ID NO: 1070 - DNA, 23 bp, Artificial
  gRNA target site sequence
cctgtctcctgggttcccgtggg

SEQ ID NO: 1071 - DNA, 23 bp, Artificial
  gRNA target site sequence
gcctgtctcctgggttcccgtgg

SEQ ID NO: 1072 - DNA, 23 bp, Artificial
  gRNA target site sequence
atctgtgtggcctgtctcctggg

SEQ ID NO: 1073 - DNA, 23 bp, Artificial
  gRNA target site sequence
catctgtgtggcctgtctcctgg

SEQ ID NO: 1074 - DNA, 23 bp, Artificial
  gRNA target site sequence
ctgcagttttagcatctgtgtgg

SEQ ID NO: 1075 - DNA, 23 bp, Artificial
  gRNA target site sequence
ttccactctgcccctcccagagg

SEQ ID NO: 1076 - DNA, 23 bp, Artificial
  gRNA target site sequence
tcgagtacatgaattgcacttgg

SEQ ID NO: 1077 - DNA, 23 bp, Artificial
  gRNA target site sequence
ccaacctcactctgcattattgg

SEQ ID NO: 1078 - DNA, 23 bp, Artificial
  gRNA target site sequence
tctgcattattggtatgagaagg

SEQ ID NO: 1079 - DNA, 23 bp, Artificial
  gRNA target site sequence
ctgcattattggtatgagaaggg

SEQ ID NO: 1080 - DNA, 23 bp, Artificial
  gRNA target site sequence
tattggtatgagaagggacgagg

SEQ ID NO: 1081 - DNA, 23 bp, Artificial
  gRNA target site sequence
attggtatgagaagggacgaggg

SEQ ID NO: 1082 - DNA, 23 bp, Artificial
  gRNA target site sequence
ttggtatgagaagggacgagggg

SEQ ID NO: 1083 - DNA, 23 bp, Artificial
  gRNA target site sequence
tggtatgagaagggacgaggggg

SEQ ID NO: 1084 - DNA, 23 bp, Artificial
  gRNA target site sequence
tatgagaagggacgagggggagg

SEQ ID NO: 1085 - DNA, 23 bp, Artificial
  gRNA target site sequence
atgagaagggacgagggggaggg

SEQ ID NO: 1086 - DNA, 23 bp, Artificial
  gRNA target site sequence
ctagattggggagaaaatgaagg

SEQ ID NO: 1087 - DNA, 23 bp, Artificial
  gRNA target site sequence
tcaggaagaaatctagattgggg

SEQ ID NO: 1088 - DNA, 23 bp, Artificial
  gRNA target site sequence
gtcaggaagaaatctagattggg

SEQ ID NO: 1089 - DNA, 23 bp, Artificial
  gRNA target site sequence
ggtcaggaagaaatctagattgg

SEQ ID NO: 1090 - DNA, 23 bp, Artificial
  gRNA target site sequence
agtcagtgggcatagtggtcagg

SEQ ID NO: 1091 - DNA, 23 bp, Artificial
  gRNA target site sequence
gagggagtcagtgggcatagtgg

SEQ ID NO: 1092 - DNA, 23 bp, Artificial
  gRNA target site sequence
gaaacactgagggagtcagtggg

SEQ ID NO: 1093 - DNA, 23 bp, Artificial
  gRNA target site sequence
ggaaacactgagggagtcagtgg

SEQ ID NO: 1094 - DNA, 23 bp, Artificial
  gRNA target site sequence
gggcagagtggaaacactgaggg

SEQ ID NO: 1095 - DNA, 23 bp, Artificial
  gRNA target site sequence
ggggcagagtggaaacactgagg

SEQ ID NO: 1096 - DNA, 23 bp, Artificial
  gRNA target site sequence
aacctctgggaggggcagagtgg

SEQ ID NO: 1097 - DNA, 23 bp, Artificial
  gRNA target site sequence
aaacactgaacctctgggagggg

SEQ ID NO: 1098 - DNA, 23 bp, Artificial
  gRNA target site sequence
aaaacactgaacctctgggaggg

SEQ ID NO: 1099 - DNA, 23 bp, Artificial
  gRNA target site sequence
caaaacactgaacctctgggagg

SEQ ID NO: 1100 - DNA, 23 bp, Artificial
  gRNA target site sequence
acacaaaacactgaacctctggg

SEQ ID NO: 1101 - DNA, 23 bp, Artificial
  gRNA target site sequence
aacacaaaacactgaacctctgg

SEQ ID NO: 1102 - DNA, 23 bp, Artificial
  gRNA target site sequence
agagtgaggttggtaggctgggg

SEQ ID NO: 1103 - DNA, 23 bp, Artificial
  gRNA target site sequence
cagagtgaggttggtaggctggg

SEQ ID NO: 1104 - DNA, 23 bp, Artificial
  gRNA target site sequence
gcagagtgaggttggtaggctgg

SEQ ID NO: 1105 - DNA, 23 bp, Artificial
  gRNA target site sequence
taatgcagagtgaggttggtagg

SEQ ID NO: 1106 - DNA, 23 bp, Artificial
  gRNA target site sequence
ccaataatgcagagtgaggttgg

SEQ ID NO: 1107 - DNA, 23 bp, Artificial
  gRNA target site sequence
cataccaataatgcagagtgagg

SEQ ID NO: 1108 - DNA, 23 bp, Artificial
  gRNA target site sequence
attcctgcagctgcccctgctgg

SEQ ID NO: 1109 - DNA, 23 bp, Artificial
  gRNA target site sequence
ttcctgcagctgcccctgctggg

SEQ ID NO: 1110 - DNA, 23 bp, Artificial
  gRNA target site sequence
gcagctgcccctgctgggagtgg

SEQ ID NO: 1111 - DNA, 23 bp, Artificial
  gRNA target site sequence
cagctgcccctgctgggagtggg

SEQ ID NO: 1112 - DNA, 23 bp, Artificial
  gRNA target site sequence
agctgcccctgctgggagtgggg

SEQ ID NO: 1113 - DNA, 23 bp, Artificial
  gRNA target site sequence
acgacaattctgacgcccaatgg

SEQ ID NO: 1114 - DNA, 23 bp, Artificial
  gRNA target site sequence
cgacaattctgacgcccaatggg

SEQ ID NO: 1115 - DNA, 23 bp, Artificial
  gRNA target site sequence
gggaatgaagacaccacagctgg

SEQ ID NO: 1116 - DNA, 23 bp, Artificial
  gRNA target site sequence
aatgaagacaccacagctggtgg

SEQ ID NO: 1117 - DNA, 23 bp, Artificial
  gRNA target site sequence
atgaagacaccacagctggtggg

SEQ ID NO: 1118 - DNA, 23 bp, Artificial
  gRNA target site sequence
accacagctggtgggaaatctgg

SEQ ID NO: 1119 - DNA, 23 bp, Artificial
  gRNA target site sequence
ccacagctggtgggaaatctggg

SEQ ID NO: 1120 - DNA, 23 bp, Artificial
  gRNA target site sequence
gctggtgggaaatctgggactgg

SEQ ID NO: 1121 - DNA, 23 bp, Artificial
  gRNA target site sequence
ggtgggaaatctgggactggagg

SEQ ID NO: 1122 - DNA, 23 bp, Artificial
  gRNA target site sequence
gtgggaaatctgggactggaggg

SEQ ID NO: 1123 - DNA, 23 bp, Artificial
  gRNA target site sequence
tgggaaatctgggactggagggg

SEQ ID NO: 1124 - DNA, 23 bp, Artificial
  gRNA target site sequence
gggaaatctgggactggaggggg

SEQ ID NO: 1125 - DNA, 23 bp, Artificial
  gRNA target site sequence
gcgcttgctcttcattccctggg

SEQ ID NO: 1126 - DNA, 23 bp, Artificial
  gRNA target site sequence
ggcgcttgctcttcattccctgg

SEQ ID NO: 1127 - DNA, 23 bp, Artificial
  gRNA target site sequence
tggtaatgatggcttcaacatgg

SEQ ID NO: 1128 - DNA, 23 bp, Artificial
  gRNA target site sequence
agggatgtgaatggtaatgatgg

SEQ ID NO: 1129 - DNA, 23 bp, Artificial
  gRNA target site sequence
aggaataagagggatgtgaatgg

SEQ ID NO: 1130 - DNA, 23 bp, Artificial
  gRNA target site sequence
gggcagctgcaggaataagaggg

SEQ ID NO: 1131 - DNA, 23 bp, Artificial
  gRNA target site sequence
ggggcagctgcaggaataagagg

SEQ ID NO: 1132 - DNA, 23 bp, Artificial
  gRNA target site sequence
ctcccagcaggggcagctgcagg

SEQ ID NO: 1133 - DNA, 23 bp, Artificial
  gRNA target site sequence
ttcagccccactcccagcagggg

SEQ ID NO: 1134 - DNA, 23 bp, Artificial
  gRNA target site sequence
gttcagccccactcccagcaggg

SEQ ID NO: 1135 - DNA, 23 bp, Artificial
  gRNA target site sequence
tgttcagccccactcccagcagg

SEQ ID NO: 1136 - DNA, 23 bp, Artificial
  gRNA target site sequence
gtggtgtcttcattcccattggg

SEQ ID NO: 1137 - DNA, 23 bp, Artificial
  gRNA target site sequence
tgtggtgtcttcattcccattgg

SEQ ID NO: 1138 - DNA, 23 bp, Artificial
  gRNA target site sequence
cccagatttcccaccagctgtgg

SEQ ID NO: 1139 - DNA, 23 bp, Artificial
  gRNA target site sequence
tctctcagaatgacaattctagg

SEQ ID NO: 1140 - DNA, 23 bp, Artificial
  gRNA target site sequence
acaattctaggtacaacttttgg

SEQ ID NO: 1141 - DNA, 23 bp, Artificial
  gRNA target site sequence
tctaggtacaacttttggcatgg

SEQ ID NO: 1142 - DNA, 23 bp, Artificial
  gRNA target site sequence
tctttacttcaagtcgtttctgg

SEQ ID NO: 1143 - DNA, 23 bp, Artificial
  gRNA target site sequence
caagtcgtttctggagaaagtgg

SEQ ID NO: 1144 - DNA, 23 bp, Artificial
  gRNA target site sequence
gaaagtggctatgctcaaaatgg

SEQ ID NO: 1145 - DNA, 23 bp, Artificial
  gRNA target site sequence
ctgcatgtttgttcctccccagg

SEQ ID NO: 1146 - DNA, 23 bp, Artificial
  gRNA target site sequence
ttgttcctccccaggagacttgg

SEQ ID NO: 1147 - DNA, 23 bp, Artificial
  gRNA target site sequence
agacttggaagatgcagaactgg

SEQ ID NO: 1148 - DNA, 23 bp, Artificial
  gRNA target site sequence
attctcatgctatagccagttgg

SEQ ID NO: 1149 - DNA, 23 bp, Artificial
  gRNA target site sequence
tatagccagttggaagtgaatgg

SEQ ID NO: 1150 - DNA, 23 bp, Artificial
  gRNA target site sequence
ctcactgacctgtgcttttgagg

SEQ ID NO: 1151 - DNA, 23 bp, Artificial
  gRNA target site sequence
agatgtcaacatcaccaatctgg

SEQ ID NO: 1152 - DNA, 23 bp, Artificial
  gRNA target site sequence
ccaatctggaatttgaaatatgg

SEQ ID NO: 1153 - DNA, 23 bp, Artificial
  gRNA target site sequence
ctggaatttgaaatatggtgagg

SEQ ID NO: 1154 - DNA, 23 bp, Artificial
  gRNA target site sequence
tggaatttgaaatatggtgaggg

SEQ ID NO: 1155 - DNA, 23 bp, Artificial
  gRNA target site sequence
atttgaaatatggtgagggatgg

SEQ ID NO: 1156 - DNA, 23 bp, Artificial
  gRNA target site sequence
tgaaatatggtgagggatggtgg

SEQ ID NO: 1157 - DNA, 23 bp, Artificial
  gRNA target site sequence
gtgagggatggtggttttaatgg

SEQ ID NO: 1158 - DNA, 23 bp, Artificial
  gRNA target site sequence
atcttccaagtctcctggggagg

SEQ ID NO: 1159 - DNA, 23 bp, Artificial
  gRNA target site sequence
tgcatcttccaagtctcctgggg

SEQ ID NO: 1160 - DNA, 23 bp, Artificial
  gRNA target site sequence
ctgcatcttccaagtctcctggg

SEQ ID NO: 1161 - DNA, 23 bp, Artificial
  gRNA target site sequence
tctgcatcttccaagtctcctgg

SEQ ID NO: 1162 - DNA, 23 bp, Artificial
  gRNA target site sequence
gcgatccattcacttccaactgg

SEQ ID NO: 1163 - DNA, 23 bp, Artificial
  gRNA target site sequence
atctgggtcctcaaaagcacagg

SEQ ID NO: 1164 - DNA, 23 bp, Artificial
  gRNA target site sequence
gattggtgatgttgacatctggg

SEQ ID NO: 1165 - DNA, 23 bp, Artificial
  gRNA target site sequence
agattggtgatgttgacatctgg

SEQ ID NO: 1166 - DNA, 23 bp, Artificial
  gRNA target site sequence
ccatatttcaaattccagattgg

SEQ ID NO: 1167 - DNA, 23 bp, Artificial
  gRNA target site sequence
tcccctttttattcctacagtgg

SEQ ID NO: 1168 - DNA, 23 bp, Artificial
  gRNA target site sequence
cccctttttattcctacagtggg

SEQ ID NO: 1169 - DNA, 23 bp, Artificial
  gRNA target site sequence
ccctttttattcctacagtgggg

SEQ ID NO: 1170 - DNA, 23 bp, Artificial
  gRNA target site sequence
ttcctacagtggggccctcgtgg

SEQ ID NO: 1171 - DNA, 23 bp, Artificial
  gRNA target site sequence
ctacagtggggccctcgtggagg

SEQ ID NO: 1172 - DNA, 23 bp, Artificial
  gRNA target site sequence
aggtaaagtgcctgaatttcagg

SEQ ID NO: 1173 - DNA, 23 bp, Artificial
  gRNA target site sequence
acaaagaaattcttactgattgg

SEQ ID NO: 1174 - DNA, 23 bp, Artificial
  gRNA target site sequence
aaagagcaatatatgtgtgaagg

SEQ ID NO: 1175 - DNA, 23 bp, Artificial
  gRNA target site sequence
agcaatatatgtgtgaaggttgg

SEQ ID NO: 1176 - DNA, 23 bp, Artificial
  gRNA target site sequence
aaaatagacctaaccactatagg

SEQ ID NO: 1177 - DNA, 23 bp, Artificial
  gRNA target site sequence
cccactgtaggaataaaaagggg

SEQ ID NO: 1178 - DNA, 23 bp, Artificial
  gRNA target site sequence
ccccactgtaggaataaaaaggg

SEQ ID NO: 1179 - DNA, 23 bp, Artificial
  gRNA target site sequence
gccccactgtaggaataaaaagg

SEQ ID NO: 1180 - DNA, 23 bp, Artificial
  gRNA target site sequence
ctccacgagggccccactgtagg

SEQ ID NO: 1181 - DNA, 23 bp, Artificial
  gRNA target site sequence
caggcactttacctccacgaggg

SEQ ID NO: 1182 - DNA, 23 bp, Artificial
  gRNA target site sequence
tcaggcactttacctccacgagg

SEQ ID NO: 1183 - DNA, 23 bp, Artificial
  gRNA target site sequence
cttgtagtttcctgaaattcagg

SEQ ID NO: 1184 - DNA, 23 bp, Artificial
  gRNA target site sequence
ggttaggtctatttttttgcagg

SEQ ID NO: 1185 - DNA, 23 bp, Artificial
  gRNA target site sequence
acttcttacctatagtggttagg

SEQ ID NO: 1186 - DNA, 23 bp, Artificial
  gRNA target site sequence
atacaacttcttacctatagtgg

SEQ ID NO: 1187 - DNA, 23 bp, Artificial
  gRNA target site sequence
ttcttttccagttaaacctgagg

SEQ ID NO: 1188 - DNA, 23 bp, Artificial
  gRNA target site sequence
ttgacctgagtgtcgtctatcgg

SEQ ID NO: 1189 - DNA, 23 bp, Artificial
  gRNA target site sequence
tgacctgagtgtcgtctatcggg

SEQ ID NO: 1190 - DNA, 23 bp, Artificial
  gRNA target site sequence
ctgagtgtcgtctatcgggaagg

SEQ ID NO: 1191 - DNA, 23 bp, Artificial
  gRNA target site sequence
ggaaggagccaatgactttgtgg

SEQ ID NO: 1192 - DNA, 23 bp, Artificial
  gRNA target site sequence
gcacgatgtagcttaccgccagg

SEQ ID NO: 1193 - DNA, 23 bp, Artificial
  gRNA target site sequence
tgtagcttaccgccaggaaaagg

SEQ ID NO: 1194 - DNA, 23 bp, Artificial
  gRNA target site sequence
aggaaaaggatgaaaacaaatgg

SEQ ID NO: 1195 - DNA, 23 bp, Artificial
  gRNA target site sequence
aaaggatgaaaacaaatggacgg

SEQ ID NO: 1196 - DNA, 23 bp, Artificial
  gRNA target site sequence
aaaggagcctcaggtttaactgg

SEQ ID NO: 1197 - DNA, 23 bp, Artificial
  gRNA target site sequence
ctcaggtcaaaaggagcctcagg

SEQ ID NO: 1198 - DNA, 23 bp, Artificial
  gRNA target site sequence
tagacgacactcaggtcaaaagg

SEQ ID NO: 1199 - DNA, 23 bp, Artificial
  gRNA target site sequence
cttcccgatagacgacactcagg

SEQ ID NO: 1200 - DNA, 23 bp, Artificial
  gRNA target site sequence
aaatgtcaccacaaagtcattgg

SEQ ID NO: 1201 - DNA, 23 bp, Artificial
  gRNA target site sequence
tgttttcatccttttcctggcgg

SEQ ID NO: 1202 - DNA, 23 bp, Artificial
  gRNA target site sequence
atttgttttcatccttttcctgg

SEQ ID NO: 1203 - DNA, 23 bp, Artificial
  gRNA target site sequence
cctgcagagaaagctccaaccgg

SEQ ID NO: 1204 - DNA, 23 bp, Artificial
  gRNA target site sequence
atccctgatcactattttaaagg

SEQ ID NO: 1205 - DNA, 23 bp, Artificial
  gRNA target site sequence
atcactattttaaaggcttctgg

SEQ ID NO: 1206 - DNA, 23 bp, Artificial
  gRNA target site sequence
ttaaaggcttctggagtgaatgg

SEQ ID NO: 1207 - DNA, 23 bp, Artificial
  gRNA target site sequence
ccagagatcaataatagctcagg

SEQ ID NO: 1208 - DNA, 23 bp, Artificial
  gRNA target site sequence
gatcaataatagctcaggtaagg

SEQ ID NO: 1209 - DNA, 23 bp, Artificial
  gRNA target site sequence
ataatagctcaggtaaggaatgg

SEQ ID NO: 1210 - DNA, 23 bp, Artificial
  gRNA target site sequence
atagctcaggtaaggaatggtgg

SEQ ID NO: 1211 - DNA, 23 bp, Artificial
  gRNA target site sequence
caggagtgtcagctttgtgctgg

SEQ ID NO: 1212 - DNA, 23 bp, Artificial
  gRNA target site sequence
ccggttggagctttctctgcagg

SEQ ID NO: 1213 - DNA, 23 bp, Artificial
  gRNA target site sequence
tctcatacattgctgccggttgg

SEQ ID NO: 1214 - DNA, 23 bp, Artificial
  gRNA target site sequence
ttaatctcatacattgctgccgg

SEQ ID NO: 1215 - DNA, 23 bp, Artificial
  gRNA target site sequence
tttaaaatagtgatcagggatgg

SEQ ID NO: 1216 - DNA, 23 bp, Artificial
  gRNA target site sequence
agcctttaaaatagtgatcaggg

SEQ ID NO: 1217 - DNA, 23 bp, Artificial
  gRNA target site sequence
aagcctttaaaatagtgatcagg

SEQ ID NO: 1218 - DNA, 23 bp, Artificial
  gRNA target site sequence
ggagttctgaagtaataacttgg

SEQ ID NO: 1219 - DNA, 23 bp, Artificial
  gRNA target site sequence
cctgagctattattgatctctgg

SEQ ID NO: 1220 - DNA, 23 bp, Artificial
  gRNA target site sequence
acaatctattcttgctttccagg

SEQ ID NO: 1221 - DNA, 23 bp, Artificial
  gRNA target site sequence
caatctattcttgctttccaggg

SEQ ID NO: 1222 - DNA, 23 bp, Artificial
  gRNA target site sequence
aatctattcttgctttccagggg

SEQ ID NO: 1223 - DNA, 23 bp, Artificial
  gRNA target site sequence
ttcttgctttccaggggagatgg

SEQ ID NO: 1224 - DNA, 23 bp, Artificial
  gRNA target site sequence
ttttttctctgtcgctctgttgg

SEQ ID NO: 1225 - DNA, 23 bp, Artificial
  gRNA target site sequence
tgtcgctctgttggtcatcttgg

SEQ ID NO: 1226 - DNA, 23 bp, Artificial
  gRNA target site sequence
tcatcttggcctgtgtgttatgg

SEQ ID NO: 1227 - DNA, 23 bp, Artificial
  gRNA target site sequence
cctgtgtgttatggaaaaaaagg

SEQ ID NO: 1228 - DNA, 23 bp, Artificial
  gRNA target site sequence
tggaaagcaagaatagattgtgg

SEQ ID NO: 1229 - DNA, 23 bp, Artificial
  gRNA target site sequence
aagataggatccatctcccctgg

SEQ ID NO: 1230 - DNA, 23 bp, Artificial
  gRNA target site sequence
atgctgatggttagtaagatagg

SEQ ID NO: 1231 - DNA, 23 bp, Artificial
  gRNA target site sequence
gaaaaaactcaaaatgctgatgg

SEQ ID NO: 1232 - DNA, 23 bp, Artificial
  gRNA target site sequence
cctttttttccataacacacagg

SEQ ID NO: 1233 - DNA, 23 bp, Artificial
  gRNA target site sequence
tatcaatgttctctgatttcagg

SEQ ID NO: 1234 - DNA, 23 bp, Artificial
  gRNA target site sequence
tcaggattaagcctatcgtatgg

SEQ ID NO: 1235 - DNA, 23 bp, Artificial
  gRNA target site sequence
ccccgatcataagaagactctgg

SEQ ID NO: 1236 - DNA, 23 bp, Artificial
  gRNA target site sequence
ccaagaaaagtgagtgtttttgg

SEQ ID NO: 1237 - DNA, 23 bp, Artificial
  gRNA target site sequence
gggagactgggccatacgatagg

SEQ ID NO: 1238 - DNA, 23 bp, Artificial
  gRNA target site sequence
ttcttatgatcggggagactggg

SEQ ID NO: 1239 - DNA, 23 bp, Artificial
  gRNA target site sequence
cttcttatgatcggggagactgg

SEQ ID NO: 1240 - DNA, 23 bp, Artificial
  gRNA target site sequence
ccagagtcttcttatgatcgggg

SEQ ID NO: 1241 - DNA, 23 bp, Artificial
  gRNA target site sequence
tccagagtcttcttatgatcggg

SEQ ID NO: 1242 - DNA, 23 bp, Artificial
  gRNA target site sequence
ttccagagtcttcttatgatcgg

SEQ ID NO: 1243 - DNA, 23 bp, Artificial
  gRNA target site sequence
ccaaaaacactcacttttcttgg

SEQ ID NO: 1244 - DNA, 23 bp, Artificial
  gRNA target site sequence
tttcaatcctgaaagtttcctgg

SEQ ID NO: 1245 - DNA, 23 bp, Artificial
  gRNA target site sequence
tcctggactgccagattcatagg

SEQ ID NO: 1246 - DNA, 23 bp, Artificial
  gRNA target site sequence
cctggactgccagattcataggg

SEQ ID NO: 1247 - DNA, 23 bp, Artificial
  gRNA target site sequence
ggactgccagattcatagggtgg

SEQ ID NO: 1248 - DNA, 23 bp, Artificial
  gRNA target site sequence
cattcaagctagagatgaagtgg

SEQ ID NO: 1249 - DNA, 23 bp, Artificial
  gRNA target site sequence
caagctagagatgaagtggaagg

SEQ ID NO: 1250 - DNA, 23 bp, Artificial
  gRNA target site sequence
tagaagaatctgagaagcagagg

SEQ ID NO: 1251 - DNA, 23 bp, Artificial
  gRNA target site sequence
gaatctgagaagcagaggcttgg

SEQ ID NO: 1252 - DNA, 23 bp, Artificial
  gRNA target site sequence
tctgagaagcagaggcttggagg

SEQ ID NO: 1253 - DNA, 23 bp, Artificial
  gRNA target site sequence
ctgagaagcagaggcttggaggg

SEQ ID NO: 1254 - DNA, 23 bp, Artificial
  gRNA target site sequence
tgagaagcagaggcttggagggg

SEQ ID NO: 1255 - DNA, 23 bp, Artificial
  gRNA target site sequence
gagccccaactgcccatctgagg

SEQ ID NO: 1256 - DNA, 23 bp, Artificial
  gRNA target site sequence
gtcatcactccagaaagctttgg

SEQ ID NO: 1257 - DNA, 23 bp, Artificial
  gRNA target site sequence
agattcatccctcacatgcctgg

SEQ ID NO: 1258 - DNA, 23 bp, Artificial
  gRNA target site sequence
tcatccctcacatgcctggctgg

SEQ ID NO: 1259 - DNA, 23 bp, Artificial
  gRNA target site sequence
catccctcacatgcctggctggg

SEQ ID NO: 1260 - DNA, 23 bp, Artificial
  gRNA target site sequence
cccctattctctcctcttccagg

SEQ ID NO: 1261 - DNA, 23 bp, Artificial
  gRNA target site sequence
cttccaggtccctagactgcagg

SEQ ID NO: 1262 - DNA, 23 bp, Artificial
  gRNA target site sequence
ttccaggtccctagactgcaggg

SEQ ID NO: 1263 - DNA, 23 bp, Artificial
  gRNA target site sequence
tccctagactgcagggagagtgg

SEQ ID NO: 1264 - DNA, 23 bp, Artificial
  gRNA target site sequence
tgcagggagagtggcaagaatgg

SEQ ID NO: 1265 - DNA, 23 bp, Artificial
  gRNA target site sequence
gcagggagagtggcaagaatggg

SEQ ID NO: 1266 - DNA, 23 bp, Artificial
  gRNA target site sequence
gaatgggcctcatgtgtaccagg

SEQ ID NO: 1267 - DNA, 23 bp, Artificial
  gRNA target site sequence
caggacctcctgcttagccttgg

SEQ ID NO: 1268 - DNA, 23 bp, Artificial
  gRNA target site sequence
aggacctcctgcttagccttggg

SEQ ID NO: 1269 - DNA, 23 bp, Artificial
  gRNA target site sequence
cctccattttctctccaatctgg

SEQ ID NO: 1270 - DNA, 23 bp, Artificial
  gRNA target site sequence
gacattgaacccagttgctcagg

SEQ ID NO: 1271 - DNA, 23 bp, Artificial
  gRNA target site sequence
acattgaacccagttgctcaggg

SEQ ID NO: 1272 - DNA, 23 bp, Artificial
  gRNA target site sequence
tcagcccattcttacttccctgg

SEQ ID NO: 1273 - DNA, 23 bp, Artificial
  gRNA target site sequence
cagcccattcttacttccctggg

SEQ ID NO: 1274 - DNA, 23 bp, Artificial
  gRNA target site sequence
ctgcacagaaaaaggagaaaggg

SEQ ID NO: 1275 - DNA, 23 bp, Artificial
  gRNA target site sequence
tctgcacagaaaaaggagaaagg

SEQ ID NO: 1276 - DNA, 23 bp, Artificial
  gRNA target site sequence
tttaaattctgcacagaaaaagg

SEQ ID NO: 1277 - DNA, 23 bp, Artificial
  gRNA target site sequence
tggcagtccaggaaactttcagg

SEQ ID NO: 1278 - DNA, 23 bp, Artificial
  gRNA target site sequence
ccctatgaatctggcagtccagg

SEQ ID NO: 1279 - DNA, 23 bp, Artificial
  gRNA target site sequence
tgtcatccaccctatgaatctgg

SEQ ID NO: 1280 - DNA, 23 bp, Artificial
  gRNA target site sequence
tcagattcttctagttgctgagg

SEQ ID NO: 1281 - DNA, 23 bp, Artificial
  gRNA target site sequence
catcctcagatgggcagttgggg

SEQ ID NO: 1282 - DNA, 23 bp, Artificial
  gRNA target site sequence
acatcctcagatgggcagttggg

SEQ ID NO: 1283 - DNA, 23 bp, Artificial
  gRNA target site sequence
tacatcctcagatgggcagttgg

SEQ ID NO: 1284 - DNA, 23 bp, Artificial
  gRNA target site sequence
tgatgactacatcctcagatggg

SEQ ID NO: 1285 - DNA, 23 bp, Artificial
  gRNA target site sequence
gtgatgactacatcctcagatgg

SEQ ID NO: 1286 - DNA, 23 bp, Artificial
  gRNA target site sequence
gaatctcttccaaagctttctgg

SEQ ID NO: 1287 - DNA, 23 bp, Artificial
  gRNA target site sequence
attcccagccaggcatgtgaggg

SEQ ID NO: 1288 - DNA, 23 bp, Artificial
  gRNA target site sequence
cattcccagccaggcatgtgagg

SEQ ID NO: 1289 - DNA, 23 bp, Artificial
  gRNA target site sequence
atgcactgacattcccagccagg

SEQ ID NO: 1290 - DNA, 23 bp, Artificial
  gRNA target site sequence
cctggaagaggagagaatagggg

SEQ ID NO: 1291 - DNA, 23 bp, Artificial
  gRNA target site sequence
acctggaagaggagagaataggg

SEQ ID NO: 1292 - DNA, 23 bp, Artificial
  gRNA target site sequence
gacctggaagaggagagaatagg

SEQ ID NO: 1293 - DNA, 23 bp, Artificial
  gRNA target site sequence
gcagtctagggacctggaagagg

SEQ ID NO: 1294 - DNA, 23 bp, Artificial
  gRNA target site sequence
ctccctgcagtctagggacctgg

SEQ ID NO: 1295 - DNA, 23 bp, Artificial
  gRNA target site sequence
gccactctccctgcagtctaggg

SEQ ID NO: 1296 - DNA, 23 bp, Artificial
  gRNA target site sequence
tgccactctccctgcagtctagg

SEQ ID NO: 1297 - DNA, 23 bp, Artificial
  gRNA target site sequence
aggaggtcctggtacacatgagg

SEQ ID NO: 1298 - DNA, 23 bp, Artificial
  gRNA target site sequence
caaggctaagcaggaggtcctgg

SEQ ID NO: 1299 - DNA, 23 bp, Artificial
  gRNA target site sequence
tagtcccaaggctaagcaggagg

SEQ ID NO: 1300 - DNA, 23 bp, Artificial
  gRNA target site sequence
ttgtagtcccaaggctaagcagg

SEQ ID NO: 1301 - DNA, 23 bp, Artificial
  gRNA target site sequence
gcgtgctgtttgtagtcccaagg

SEQ ID NO: 1302 - DNA, 23 bp, Artificial
  gRNA target site sequence
gattggagagaaaatggaggggg

SEQ ID NO: 1303 - DNA, 23 bp, Artificial
  gRNA target site sequence
agattggagagaaaatggagggg

SEQ ID NO: 1304 - DNA, 23 bp, Artificial
  gRNA target site sequence
cagattggagagaaaatggaggg

SEQ ID NO: 1305 - DNA, 23 bp, Artificial
  gRNA target site sequence
ccagattggagagaaaatggagg

SEQ ID NO: 1306 - DNA, 23 bp, Artificial
  gRNA target site sequence
attccagattggagagaaaatgg

SEQ ID NO: 1307 - DNA, 23 bp, Artificial
  gRNA target site sequence
tcaatgtcaggattccagattgg

SEQ ID NO: 1308 - DNA, 23 bp, Artificial
  gRNA target site sequence
gagcaactgggttcaatgtcagg

SEQ ID NO: 1309 - DNA, 23 bp, Artificial
  gRNA target site sequence
tgggctgaccctgagcaactggg

SEQ ID NO: 1310 - DNA, 23 bp, Artificial
  gRNA target site sequence
atgggctgaccctgagcaactgg

SEQ ID NO: 1311 - DNA, 23 bp, Artificial
  gRNA target site sequence
gatcccagggaagtaagaatggg

SEQ ID NO: 1312 - DNA, 23 bp, Artificial
  gRNA target site sequence
tgatcccagggaagtaagaatgg

SEQ ID NO: 1313 - DNA, 23 bp, Artificial
  gRNA target site sequence
ttcttcttgatttgatcccaggg

SEQ ID NO: 1314 - DNA, 23 bp, Artificial
  gRNA target site sequence
cttcttcttgatttgatcccagg

SEQ ID NO: 1315 - DNA, 23 bp, Artificial
  gRNA target site sequence
gttttggtagaagctggacatgg

SEQ ID NO: 1316 - DNA, 23 bp, Artificial
  gRNA target site sequence
tcactggttttggtagaagctgg

SEQ ID NO: 1317 - DNA, 23 bp, Artificial
  gRNA target site sequence
ttcttacacttcactggttttgg

SEQ ID NO: 1318 - DNA, 23 bp, Artificial
  gRNA target site sequence
ctgggtttcttacacttcactgg

SEQ ID NO: 1319 - DNA, 23 bp, Artificial
  gRNA target site sequence
ttatctgtcccccgcccctcagg

SEQ ID NO: 1320 - DNA, 23 bp, Artificial
  gRNA target site sequence
acgagctcatgaagctgtgctgg

SEQ ID NO: 1321 - DNA, 23 bp, Artificial
  gRNA target site sequence
cgagctcatgaagctgtgctggg

SEQ ID NO: 1322 - DNA, 23 bp, Artificial
  gRNA target site sequence
gtgctgggcccctagcccacagg

SEQ ID NO: 1323 - DNA, 23 bp, Artificial
  gRNA target site sequence
gggcccctagcccacaggaccgg

SEQ ID NO: 1324 - DNA, 23 bp, Artificial
  gRNA target site sequence
ccggccatcattcagcgccctgg

SEQ ID NO: 1325 - DNA, 23 bp, Artificial
  gRNA target site sequence
cggccatcattcagcgccctggg

SEQ ID NO: 1326 - DNA, 23 bp, Artificial
  gRNA target site sequence
cagcgccctgggcccccagctgg

SEQ ID NO: 1327 - DNA, 23 bp, Artificial
  gRNA target site sequence
gcccccagctggacatgctgtgg

SEQ ID NO: 1328 - DNA, 23 bp, Artificial
  gRNA target site sequence
cagctggacatgctgtggagcgg

SEQ ID NO: 1329 - DNA, 23 bp, Artificial
  gRNA target site sequence
acatgctgtggagcggaagccgg

SEQ ID NO: 1330 - DNA, 23 bp, Artificial
  gRNA target site sequence
catgctgtggagcggaagccggg

SEQ ID NO: 1331 - DNA, 23 bp, Artificial
  gRNA target site sequence
atgctgtggagcggaagccgggg

SEQ ID NO: 1332 - DNA, 23 bp, Artificial
  gRNA target site sequence
tgctgtggagcggaagccggggg

SEQ ID NO: 1333 - DNA, 23 bp, Artificial
  gRNA target site sequence
tgccttcactgctcacccagagg

SEQ ID NO: 1334 - DNA, 23 bp, Artificial
  gRNA target site sequence
gccttcactgctcacccagaggg

SEQ ID NO: 1335 - DNA, 23 bp, Artificial
  gRNA target site sequence
agctcctgcccgcagacctctgg

SEQ ID NO: 1336 - DNA, 23 bp, Artificial
  gRNA target site sequence
gaggggcgggggacagataatgg

SEQ ID NO: 1337 - DNA, 23 bp, Artificial
  gRNA target site sequence
ctcgtgaacctgaggggcggggg

SEQ ID NO: 1338 - DNA, 23 bp, Artificial
  gRNA target site sequence
gctcgtgaacctgaggggcgggg

SEQ ID NO: 1339 - DNA, 23 bp, Artificial
  gRNA target site sequence
agctcgtgaacctgaggggcggg

SEQ ID NO: 1340 - DNA, 23 bp, Artificial
  gRNA target site sequence
gagctcgtgaacctgaggggcgg

SEQ ID NO: 1341 - DNA, 23 bp, Artificial
  gRNA target site sequence
catgagctcgtgaacctgagggg

SEQ ID NO: 1342 - DNA, 23 bp, Artificial
  gRNA target site sequence
tcatgagctcgtgaacctgaggg

SEQ ID NO: 1343 - DNA, 23 bp, Artificial
  gRNA target site sequence
ttcatgagctcgtgaacctgagg

SEQ ID NO: 1344 - DNA, 23 bp, Artificial
  gRNA target site sequence
tggccggtcctgtgggctagggg

SEQ ID NO: 1345 - DNA, 23 bp, Artificial
  gRNA target site sequence
atggccggtcctgtgggctaggg

SEQ ID NO: 1346 - DNA, 23 bp, Artificial
  gRNA target site sequence
gatggccggtcctgtgggctagg

SEQ ID NO: 1347 - DNA, 23 bp, Artificial
  gRNA target site sequence
tgaatgatggccggtcctgtggg

SEQ ID NO: 1348 - DNA, 23 bp, Artificial
  gRNA target site sequence
ctgaatgatggccggtcctgtgg

SEQ ID NO: 1349 - DNA, 23 bp, Artificial
  gRNA target site sequence
ccagggcgctgaatgatggccgg

SEQ ID NO: 1350 - DNA, 23 bp, Artificial
  gRNA target site sequence
gggcccagggcgctgaatgatgg

SEQ ID NO: 1351 - DNA, 23 bp, Artificial
  gRNA target site sequence
catgtccagctgggggcccaggg

SEQ ID NO: 1352 - DNA, 23 bp, Artificial
  gRNA target site sequence
gcatgtccagctgggggcccagg

SEQ ID NO: 1353 - DNA, 23 bp, Artificial
  gRNA target site sequence
tccacagcatgtccagctggggg

SEQ ID NO: 1354 - DNA, 23 bp, Artificial
  gRNA target site sequence
ctccacagcatgtccagctgggg

SEQ ID NO: 1355 - DNA, 23 bp, Artificial
  gRNA target site sequence
gctccacagcatgtccagctggg

SEQ ID NO: 1356 - DNA, 23 bp, Artificial
  gRNA target site sequence
cgctccacagcatgtccagctgg

SEQ ID NO: 1357 - DNA, 23 bp, Artificial
  gRNA target site sequence
aggcatgagtctcacacccccgg

SEQ ID NO: 1358 - DNA, 23 bp, Artificial
  gRNA target site sequence
gccctctgggtgagcagtgaagg

SEQ ID NO: 1359 - DNA, 23 bp, Artificial
  gRNA target site sequence
gggagtggtgtttgccctctggg

SEQ ID NO: 1360 - DNA, 23 bp, Artificial
  gRNA target site sequence
agggagtggtgtttgccctctgg

SEQ ID NO: 1361 - DNA, 23 bp, Artificial
  gRNA target site sequence
gctatgaaaaggacagggagtgg

SEQ ID NO: 1362 - DNA, 23 bp, Artificial
  gRNA target site sequence
caggagctatgaaaaggacaggg

SEQ ID NO: 1363 - DNA, 23 bp, Artificial
  gRNA target site sequence
gcaggagctatgaaaaggacagg

SEQ ID NO: 1364 - DNA, 23 bp, Artificial
  gRNA target site sequence
tgcgggcaggagctatgaaaagg

SEQ ID NO: 1365 - DNA, 23 bp, Artificial
  gRNA target site sequence
taatccagaggtctgcgggcagg

SEQ ID NO: 1366 - DNA, 23 bp, Artificial
  gRNA target site sequence
atgcgctcctccttggctccagg

SEQ ID NO: 1367 - DNA, 23 bp, Artificial
  gRNA target site sequence
cttggctccaggagttcctgcgg

SEQ ID NO: 1368 - DNA, 23 bp, Artificial
  gRNA target site sequence
ccaggagttcctgcggatgatgg

SEQ ID NO: 1369 - DNA, 23 bp, Artificial
  gRNA target site sequence
caggagttcctgcggatgatggg

SEQ ID NO: 1370 - DNA, 23 bp, Artificial
  gRNA target site sequence
tgcggatgatgggatgtgagcgg

SEQ ID NO: 1371 - DNA, 23 bp, Artificial
  gRNA target site sequence
gcggatgatgggatgtgagcggg

SEQ ID NO: 1372 - DNA, 23 bp, Artificial
  gRNA target site sequence
ccccgccctctgccgcctcttgg

SEQ ID NO: 1373 - DNA, 23 bp, Artificial
  gRNA target site sequence
ctgccgcctcttggaactgctgg

SEQ ID NO: 1374 - DNA, 23 bp, Artificial
  gRNA target site sequence
ccgcctcttggaactgctggagg

SEQ ID NO: 1375 - DNA, 23 bp, Artificial
  gRNA target site sequence
cctcttggaactgctggaggagg

SEQ ID NO: 1376 - DNA, 23 bp, Artificial
  gRNA target site sequence
ctcttggaactgctggaggaggg

SEQ ID NO: 1377 - DNA, 23 bp, Artificial
  gRNA target site sequence
aactgctggaggagggccagagg

SEQ ID NO: 1378 - DNA, 23 bp, Artificial
  gRNA target site sequence
ggaggagggccagaggctgccgg

SEQ ID NO: 1379 - DNA, 23 bp, Artificial
  gRNA target site sequence
gcctcctgcctgccctgctgagg

SEQ ID NO: 1380 - DNA, 23 bp, Artificial
  gRNA target site sequence
cctgctgaggtgagcgccgcagg

SEQ ID NO: 1381 - DNA, 23 bp, Artificial
  gRNA target site sequence
ctgctgaggtgagcgccgcaggg

SEQ ID NO: 1382 - DNA, 23 bp, Artificial
  gRNA target site sequence
aggaactcctggagccaaggagg

SEQ ID NO: 1383 - DNA, 23 bp, Artificial
  gRNA target site sequence
cgcaggaactcctggagccaagg

SEQ ID NO: 1384 - DNA, 23 bp, Artificial
  gRNA target site sequence
ccatcatccgcaggaactcctgg

SEQ ID NO: 1385 - DNA, 23 bp, Artificial
  gRNA target site sequence
gctcacatcccatcatccgcagg

SEQ ID NO: 1386 - DNA, 23 bp, Artificial
  gRNA target site sequence
ccaagaggcggcagagggcgggg

SEQ ID NO: 1387 - DNA, 23 bp, Artificial
  gRNA target site sequence
tccaagaggcggcagagggcggg

SEQ ID NO: 1388 - DNA, 23 bp, Artificial
  gRNA target site sequence
ttccaagaggcggcagagggcgg

SEQ ID NO: 1389 - DNA, 23 bp, Artificial
  gRNA target site sequence
cagttccaagaggcggcagaggg

SEQ ID NO: 1390 - DNA, 23 bp, Artificial
  gRNA target site sequence
gcagttccaagaggcggcagagg

SEQ ID NO: 1391 - DNA, 23 bp, Artificial
  gRNA target site sequence
cctccagcagttccaagaggcgg

SEQ ID NO: 1392 - DNA, 23 bp, Artificial
  gRNA target site sequence
cctcctccagcagttccaagagg

SEQ ID NO: 1393 - DNA, 23 bp, Artificial
  gRNA target site sequence
caggaggcgccggcagcctctgg

SEQ ID NO: 1394 - DNA, 23 bp, Artificial
  gRNA target site sequence
gcagggcaggcaggaggcgccgg

SEQ ID NO: 1395 - DNA, 23 bp, Artificial
  gRNA target site sequence
acctcagcagggcaggcaggagg

SEQ ID NO: 1396 - DNA, 23 bp, Artificial
  gRNA target site sequence
ctcacctcagcagggcaggcagg

SEQ ID NO: 1397 - DNA, 23 bp, Artificial
  gRNA target site sequence
ggcgctcacctcagcagggcagg

SEQ ID NO: 1398 - DNA, 23 bp, Artificial
  gRNA target site sequence
ctgcggcgctcacctcagcaggg

SEQ ID NO: 1399 - DNA, 23 bp, Artificial
  gRNA target site sequence
cctgcggcgctcacctcagcagg

SEQ ID NO: 1400 - DNA, 23 bp, Artificial
  gRNA target site sequence
caagaccttgtcccctctccagg

SEQ ID NO: 1401 - DNA, 23 bp, Artificial
  gRNA target site sequence
gtatgcccccgaatccctctcgg

SEQ ID NO: 1402 - DNA, 23 bp, Artificial
  gRNA target site sequence
tctctcgccagtcagacgtctgg

SEQ ID NO: 1403 - DNA, 23 bp, Artificial
  gRNA target site sequence
cagtcagacgtctggagcttcgg

SEQ ID NO: 1404 - DNA, 23 bp, Artificial
  gRNA target site sequence
agtcagacgtctggagcttcggg

SEQ ID NO: 1405 - DNA, 23 bp, Artificial
  gRNA target site sequence
gtcagacgtctggagcttcgggg

SEQ ID NO: 1406 - DNA, 23 bp, Artificial
  gRNA target site sequence
cgacaaaagctgcagcccctcgg

SEQ ID NO: 1407 - DNA, 23 bp, Artificial
  gRNA target site sequence
gcagcccctcggccgtgagtcgg

SEQ ID NO: 1408 - DNA, 23 bp, Artificial
  gRNA target site sequence
gcatacctggagaggggacaagg

SEQ ID NO: 1409 - DNA, 23 bp, Artificial
  gRNA target site sequence
tcgggggcatacctggagagggg

SEQ ID NO: 1410 - DNA, 23 bp, Artificial
  gRNA target site sequence
ttcgggggcatacctggagaggg

SEQ ID NO: 1411 - DNA, 23 bp, Artificial
  gRNA target site sequence
attcgggggcatacctggagagg

SEQ ID NO: 1412 - DNA, 23 bp, Artificial
  gRNA target site sequence
gagggattcgggggcatacctgg

SEQ ID NO: 1413 - DNA, 23 bp, Artificial
  gRNA target site sequence
gttgtccgagagggattcggggg

SEQ ID NO: 1414 - DNA, 23 bp, Artificial
  gRNA target site sequence
tgttgtccgagagggattcgggg

SEQ ID NO: 1415 - DNA, 23 bp, Artificial
  gRNA target site sequence
atgttgtccgagagggattcggg

SEQ ID NO: 1416 - DNA, 23 bp, Artificial
  gRNA target site sequence
gatgttgtccgagagggattcgg

SEQ ID NO: 1417 - DNA, 23 bp, Artificial
  gRNA target site sequence
agagaagatgttgtccgagaggg

SEQ ID NO: 1418 - DNA, 23 bp, Artificial
  gRNA target site sequence
gagagaagatgttgtccgagagg

SEQ ID NO: 1419 - DNA, 23 bp, Artificial
  gRNA target site sequence
cgaagctccagacgtctgactgg

SEQ ID NO: 1420 - DNA, 23 bp, Artificial
  gRNA target site sequence
agtaggtgaagagctcgtacagg

SEQ ID NO: 1421 - DNA, 23 bp, Artificial
  gRNA target site sequence
gctgcagcttttgtcgcagtagg

SEQ ID NO: 1422 - DNA, 23 bp, Artificial
  gRNA target site sequence
gaagccgactcacggccgagggg

SEQ ID NO: 1423 - DNA, 23 bp, Artificial
  gRNA target site sequence
ggaagccgactcacggccgaggg

SEQ ID NO: 1424 - DNA, 23 bp, Artificial
  gRNA target site sequence
gggaagccgactcacggccgagg

SEQ ID NO: 1425 - DNA, 23 bp, Artificial
  gRNA target site sequence
ggctctgggaagccgactcacgg

SEQ ID NO: 1426 - DNA, 23 bp, Artificial
  gRNA target site sequence
cgctcacaccgcccgcccgcagg

SEQ ID NO: 1427 - DNA, 23 bp, Artificial
  gRNA target site sequence
gctcacaccgcccgcccgcaggg

SEQ ID NO: 1428 - DNA, 23 bp, Artificial
  gRNA target site sequence
caccgcccgcccgcagggcatgg

SEQ ID NO: 1429 - DNA, 23 bp, Artificial
  gRNA target site sequence
cccgcagggcatggagtacctgg

SEQ ID NO: 1430 - DNA, 23 bp, Artificial
  gRNA target site sequence
ccgcagggcatggagtacctggg

SEQ ID NO: 1431 - DNA, 23 bp, Artificial
  gRNA target site sequence
ccgctgcgtgcaccgcgacctgg

SEQ ID NO: 1432 - DNA, 23 bp, Artificial
  gRNA target site sequence
ggccgcccgaaacatcctcgtgg

SEQ ID NO: 1433 - DNA, 23 bp, Artificial
  gRNA target site sequence
aaacatcctcgtggagagcgagg

SEQ ID NO: 1434 - DNA, 23 bp, Artificial
  gRNA target site sequence
cacgtcaagatcgctgacttcgg

SEQ ID NO: 1435 - DNA, 23 bp, Artificial
  gRNA target site sequence
gcttgacaaagactactacgtgg

SEQ ID NO: 1436 - DNA, 23 bp, Artificial
  gRNA target site sequence
tactacgtggtccgcgagccagg

SEQ ID NO: 1437 - DNA, 23 bp, Artificial
  gRNA target site sequence
caggccagagccccattttctgg

SEQ ID NO: 1438 - DNA, 23 bp, Artificial
  gRNA target site sequence
gccagagccccattttctggtgg

SEQ ID NO: 1439 - DNA, 23 bp, Artificial
  gRNA target site sequence
ccagagccccattttctggtggg

SEQ ID NO: 1440 - DNA, 23 bp, Artificial
  gRNA target site sequence
cagagccccattttctggtgggg

SEQ ID NO: 1441 - DNA, 23 bp, Artificial
  gRNA target site sequence
ctggtggggaacccgcgcctagg

SEQ ID NO: 1442 - DNA, 23 bp, Artificial
  gRNA target site sequence
ctccatgccctgcgggcgggcgg

SEQ ID NO: 1443 - DNA, 23 bp, Artificial
  gRNA target site sequence
gtactccatgccctgcgggcggg

SEQ ID NO: 1444 - DNA, 23 bp, Artificial
  gRNA target site sequence
ggtactccatgccctgcgggcgg

SEQ ID NO: 1445 - DNA, 23 bp, Artificial
  gRNA target site sequence
ccaggtactccatgccctgcggg

SEQ ID NO: 1446 - DNA, 23 bp, Artificial
  gRNA target site sequence
cccaggtactccatgccctgcgg

SEQ ID NO: 1447 - DNA, 23 bp, Artificial
  gRNA target site sequence
gcacgcagcggcgggagcccagg

SEQ ID NO: 1448 - DNA, 23 bp, Artificial
  gRNA target site sequence
gtcgcggtgcacgcagcggcggg

SEQ ID NO: 1449 - DNA, 23 bp, Artificial
  gRNA target site sequence
ggtcgcggtgcacgcagcggcgg

SEQ ID NO: 1450 - DNA, 23 bp, Artificial
  gRNA target site sequence
ccaggtcgcggtgcacgcagcgg

SEQ ID NO: 1451 - DNA, 23 bp, Artificial
  gRNA target site sequence
tgtttcgggcggccaggtcgcgg

SEQ ID NO: 1452 - DNA, 23 bp, Artificial
  gRNA target site sequence
cgaggatgtttcgggcggccagg

SEQ ID NO: 1453 - DNA, 23 bp, Artificial
  gRNA target site sequence
ctccacgaggatgtttcgggcgg

SEQ ID NO: 1454 - DNA, 23 bp, Artificial
  gRNA target site sequence
gctctccacgaggatgtttcggg

SEQ ID NO: 1455 - DNA, 23 bp, Artificial
  gRNA target site sequence
cgctctccacgaggatgtttcgg

SEQ ID NO: 1456 - DNA, 23 bp, Artificial
  gRNA target site sequence
cgtgtgcctcgctctccacgagg

SEQ ID NO: 1457 - DNA, 23 bp, Artificial
  gRNA target site sequence
caagcggcagcagcttagctagg

SEQ ID NO: 1458 - DNA, 23 bp, Artificial
  gRNA target site sequence
acgtagtagtctttgtcaagcgg

SEQ ID NO: 1459 - DNA, 23 bp, Artificial
  gRNA target site sequence
tggggctctggcctggctcgcgg

SEQ ID NO: 1460 - DNA, 23 bp, Artificial
  gRNA target site sequence
cagaaaatggggctctggcctgg

SEQ ID NO: 1461 - DNA, 23 bp, Artificial
  gRNA target site sequence
cccaccagaaaatggggctctgg

SEQ ID NO: 1462 - DNA, 23 bp, Artificial
  gRNA target site sequence
gggttccccaccagaaaatgggg

SEQ ID NO: 1463 - DNA, 23 bp, Artificial
  gRNA target site sequence
cgggttccccaccagaaaatggg

SEQ ID NO: 1464 - DNA, 23 bp, Artificial
  gRNA target site sequence
gcgggttccccaccagaaaatgg

SEQ ID NO: 1465 - DNA, 23 bp, Artificial
  gRNA target site sequence
tgacagatcctgccttctccagg

SEQ ID NO: 1466 - DNA, 23 bp, Artificial
  gRNA target site sequence
ctccaggccgccagagcctgcgg

SEQ ID NO: 1467 - DNA, 23 bp, Artificial
  gRNA target site sequence
aggccgccagagcctgcggctgg

SEQ ID NO: 1468 - DNA, 23 bp, Artificial
  gRNA target site sequence
ccagagcctgcggctggtcatgg

SEQ ID NO: 1469 - DNA, 23 bp, Artificial
  gRNA target site sequence
gtcatggagtacctgcccagcgg

SEQ ID NO: 1470 - DNA, 23 bp, Artificial
  gRNA target site sequence
gcttgcgcgacttcctgcagcgg

SEQ ID NO: 1471 - DNA, 23 bp, Artificial
  gRNA target site sequence
ctattcctcgcagatctgcaagg

SEQ ID NO: 1472 - DNA, 23 bp, Artificial
  gRNA target site sequence
tcgcagatctgcaaggtgcgagg

SEQ ID NO: 1473 - DNA, 23 bp, Artificial
  gRNA target site sequence
cgcagatctgcaaggtgcgaggg

SEQ ID NO: 1474 - DNA, 23 bp, Artificial
  gRNA target site sequence
gcagatctgcaaggtgcgagggg

SEQ ID NO: 1475 - DNA, 23 bp, Artificial
  gRNA target site sequence
cagatctgcaaggtgcgaggggg

SEQ ID NO: 1476 - DNA, 23 bp, Artificial
  gRNA target site sequence
caaggtgcgagggggcgccccgg

SEQ ID NO: 1477 - DNA, 23 bp, Artificial
  gRNA target site sequence
aaggtgcgagggggcgccccggg

SEQ ID NO: 1478 - DNA, 23 bp, Artificial
  gRNA target site sequence
tctggcggcctggagaaggcagg

SEQ ID NO: 1479 - DNA, 23 bp, Artificial
  gRNA target site sequence
aggctctggcggcctggagaagg

SEQ ID NO: 1480 - DNA, 23 bp, Artificial
  gRNA target site sequence
agccgcaggctctggcggcctgg

SEQ ID NO: 1481 - DNA, 23 bp, Artificial
  gRNA target site sequence
tgaccagccgcaggctctggcgg

SEQ ID NO: 1482 - DNA, 23 bp, Artificial
  gRNA target site sequence
ccatgaccagccgcaggctctgg

SEQ ID NO: 1483 - DNA, 23 bp, Artificial
  gRNA target site sequence
ggtactccatgaccagccgcagg

SEQ ID NO: 1484 - DNA, 23 bp, Artificial
  gRNA target site sequence
cgcgcaagcagccgctgggcagg

SEQ ID NO: 1485 - DNA, 23 bp, Artificial
  gRNA target site sequence
aagtcgcgcaagcagccgctggg

SEQ ID NO: 1486 - DNA, 23 bp, Artificial
  gRNA target site sequence
gaagtcgcgcaagcagccgctgg

SEQ ID NO: 1487 - DNA, 23 bp, Artificial
  gRNA target site sequence
ggcgcgcgcggtgccgctgcagg

SEQ ID NO: 1488 - DNA, 23 bp, Artificial
  gRNA target site sequence
ggctggcatcgaggcgcgcgcgg

SEQ ID NO: 1489 - DNA, 23 bp, Artificial
  gRNA target site sequence
gaaggaggcggctggcatcgagg

SEQ ID NO: 1490 - DNA, 23 bp, Artificial
  gRNA target site sequence
ggaatagagaaggaggcggctgg

SEQ ID NO: 1491 - DNA, 23 bp, Artificial
  gRNA target site sequence
gcgaggaatagagaaggaggcgg

SEQ ID NO: 1492 - DNA, 23 bp, Artificial
  gRNA target site sequence
tctgcgaggaatagagaaggagg

SEQ ID NO: 1493 - DNA, 23 bp, Artificial
  gRNA target site sequence
agatctgcgaggaatagagaagg

SEQ ID NO: 1494 - DNA, 23 bp, Artificial
  gRNA target site sequence
tcgcaccttgcagatctgcgagg

SEQ ID NO: 1495 - DNA, 23 bp, Artificial
  gRNA target site sequence
catcagtcccgctatcccccagg

SEQ ID NO: 1496 - DNA, 23 bp, Artificial
  gRNA target site sequence
atcagtcccgctatcccccaggg

SEQ ID NO: 1497 - DNA, 23 bp, Artificial
  gRNA target site sequence
gctatcccccagggcaactttgg

SEQ ID NO: 1498 - DNA, 23 bp, Artificial
  gRNA target site sequence
ccagggcaactttggcagcgtgg

SEQ ID NO: 1499 - DNA, 23 bp, Artificial
  gRNA target site sequence
ctgtgccgctatgacccgctagg

SEQ ID NO: 1500 - DNA, 23 bp, Artificial
  gRNA target site sequence
gacccgctaggcgacaatacagg

SEQ ID NO: 1501 - DNA, 23 bp, Artificial
  gRNA target site sequence
aggcgacaatacaggtgccctgg

SEQ ID NO: 1502 - DNA, 23 bp, Artificial
  gRNA target site sequence
cgacaatacaggtgccctggtgg

SEQ ID NO: 1503 - DNA, 23 bp, Artificial
  gRNA target site sequence
gtgaaacagctgcagcacagcgg

SEQ ID NO: 1504 - DNA, 23 bp, Artificial
  gRNA target site sequence
tgaaacagctgcagcacagcggg

SEQ ID NO: 1505 - DNA, 23 bp, Artificial
  gRNA target site sequence
acagcgggccagaccagcagagg

SEQ ID NO: 1506 - DNA, 23 bp, Artificial
  gRNA target site sequence
cagcgggccagaccagcagaggg

SEQ ID NO: 1507 - DNA, 23 bp, Artificial
  gRNA target site sequence
accagcagagggactttcagcgg

SEQ ID NO: 1508 - DNA, 23 bp, Artificial
  gRNA target site sequence
ccagcagagggactttcagcggg

SEQ ID NO: 1509 - DNA, 23 bp, Artificial
  gRNA target site sequence
gatttcattgtcaagtatcgtgg

SEQ ID NO: 1510 - DNA, 23 bp, Artificial
  gRNA target site sequence
aagtatcgtggtgtcagctatgg

SEQ ID NO: 1511 - DNA, 23 bp, Artificial
  gRNA target site sequence
tcgtggtgtcagctatggcccgg

SEQ ID NO: 1512 - DNA, 23 bp, Artificial
  gRNA target site sequence
cgtggtgtcagctatggcccggg

SEQ ID NO: 1513 - DNA, 23 bp, Artificial
  gRNA target site sequence
ggcccgggtgagccagctcccgg

SEQ ID NO: 1514 - DNA, 23 bp, Artificial
  gRNA target site sequence
aagttgccctgggggatagcggg

SEQ ID NO: 1515 - DNA, 23 bp, Artificial
  gRNA target site sequence
aaagttgccctgggggatagcgg

SEQ ID NO: 1516 - DNA, 23 bp, Artificial
  gRNA target site sequence
cgctgccaaagttgccctggggg

SEQ ID NO: 1517 - DNA, 23 bp, Artificial
  gRNA target site sequence
acgctgccaaagttgccctgggg

SEQ ID NO: 1518 - DNA, 23 bp, Artificial
  gRNA target site sequence
cacgctgccaaagttgccctggg

SEQ ID NO: 1519 - DNA, 23 bp, Artificial
  gRNA target site sequence
ccacgctgccaaagttgccctgg

SEQ ID NO: 1520 - DNA, 23 bp, Artificial
  gRNA target site sequence
tgtcgcctagcgggtcatagcgg

SEQ ID NO: 1521 - DNA, 23 bp, Artificial
  gRNA target site sequence
cacctgtattgtcgcctagcggg

SEQ ID NO: 1522 - DNA, 23 bp, Artificial
  gRNA target site sequence
gcacctgtattgtcgcctagcgg

SEQ ID NO: 1523 - DNA, 23 bp, Artificial
  gRNA target site sequence
cagctgtttcacggccaccaggg

SEQ ID NO: 1524 - DNA, 23 bp, Artificial
  gRNA target site sequence
gcagctgtttcacggccaccagg

SEQ ID NO: 1525 - DNA, 23 bp, Artificial
  gRNA target site sequence
gctgtgctgcagctgtttcacgg

SEQ ID NO: 1526 - DNA, 23 bp, Artificial
  gRNA target site sequence
tgaaagtccctctgctggtctgg

SEQ ID NO: 1527 - DNA, 23 bp, Artificial
  gRNA target site sequence
cccgctgaaagtccctctgctgg

SEQ ID NO: 1528 - DNA, 23 bp, Artificial
  gRNA target site sequence
aatcactgtgcagtgctttgagg

SEQ ID NO: 1529 - DNA, 23 bp, Artificial
  gRNA target site sequence
atccgggagctggctcacccggg

SEQ ID NO: 1530 - DNA, 23 bp, Artificial
  gRNA target site sequence
catccgggagctggctcacccgg

SEQ ID NO: 1531 - DNA, 23 bp, Artificial
  gRNA target site sequence
ctcctctcagaccccacacctgg

SEQ ID NO: 1532 - DNA, 23 bp, Artificial
  gRNA target site sequence
agaccccacacctggtgccctgg

SEQ ID NO: 1533 - DNA, 23 bp, Artificial
  gRNA target site sequence
ggtgccctggcacctcgtgatgg

SEQ ID NO: 1534 - DNA, 23 bp, Artificial
  gRNA target site sequence
gtgccctggcacctcgtgatggg

SEQ ID NO: 1535 - DNA, 23 bp, Artificial
  gRNA target site sequence
tggcacctcgtgatgggctgtgg

SEQ ID NO: 1536 - DNA, 23 bp, Artificial
  gRNA target site sequence
cctcgtgatgggctgtggaatgg

SEQ ID NO: 1537 - DNA, 23 bp, Artificial
  gRNA target site sequence
ccaagaccccacgatcttcgagg

SEQ ID NO: 1538 - DNA, 23 bp, Artificial
  gRNA target site sequence
cctcaagtacatctcacagctgg

SEQ ID NO: 1539 - DNA, 23 bp, Artificial
  gRNA target site sequence
ctcaagtacatctcacagctggg

SEQ ID NO: 1540 - DNA, 23 bp, Artificial
  gRNA target site sequence
gtacatctcacagctgggcaagg

SEQ ID NO: 1541 - DNA, 23 bp, Artificial
  gRNA target site sequence
tctcacagctgggcaaggtaagg

SEQ ID NO: 1542 - DNA, 23 bp, Artificial
  gRNA target site sequence
cacagctgggcaaggtaaggtgg

SEQ ID NO: 1543 - DNA, 23 bp, Artificial
  gRNA target site sequence
acagctgggcaaggtaaggtggg

SEQ ID NO: 1544 - DNA, 23 bp, Artificial
  gRNA target site sequence
ctgggcaaggtaaggtgggcagg

SEQ ID NO: 1545 - DNA, 23 bp, Artificial
  gRNA target site sequence
tgggcaaggtaaggtgggcaggg

SEQ ID NO: 1546 - DNA, 23 bp, Artificial
  gRNA target site sequence
aaggtaaggtgggcagggccagg

SEQ ID NO: 1547 - DNA, 23 bp, Artificial
  gRNA target site sequence
aggtaaggtgggcagggccaggg

SEQ ID NO: 1548 - DNA, 23 bp, Artificial
  gRNA target site sequence
taaggtgggcagggccagggtgg

SEQ ID NO: 1549 - DNA, 23 bp, Artificial
  gRNA target site sequence
aaggtgggcagggccagggtggg

SEQ ID NO: 1550 - DNA, 23 bp, Artificial
  gRNA target site sequence
tggggtgggggcatgggcagtgg

SEQ ID NO: 1551 - DNA, 23 bp, Artificial
  gRNA target site sequence
atagtctggggtgggggcatggg

SEQ ID NO: 1552 - DNA, 23 bp, Artificial
  gRNA target site sequence
catagtctggggtgggggcatgg

SEQ ID NO: 1553 - DNA, 23 bp, Artificial
  gRNA target site sequence
gagctcatagtctggggtggggg

SEQ ID NO: 1554 - DNA, 23 bp, Artificial
  gRNA target site sequence
ggagctcatagtctggggtgggg

SEQ ID NO: 1555 - DNA, 23 bp, Artificial
  gRNA target site sequence
aggagctcatagtctggggtggg

SEQ ID NO: 1556 - DNA, 23 bp, Artificial
  gRNA target site sequence
gaggagctcatagtctggggtgg

SEQ ID NO: 1557 - DNA, 23 bp, Artificial
  gRNA target site sequence
tgagaggagctcatagtctgggg

SEQ ID NO: 1558 - DNA, 23 bp, Artificial
  gRNA target site sequence
ctgagaggagctcatagtctggg

SEQ ID NO: 1559 - DNA, 23 bp, Artificial
  gRNA target site sequence
tctgagaggagctcatagtctgg

SEQ ID NO: 1560 - DNA, 23 bp, Artificial
  gRNA target site sequence
caccaggtgtggggtctgagagg

SEQ ID NO: 1561 - DNA, 23 bp, Artificial
  gRNA target site sequence
gtgccagggcaccaggtgtgggg

SEQ ID NO: 1562 - DNA, 23 bp, Artificial
  gRNA target site sequence
ggtgccagggcaccaggtgtggg

SEQ ID NO: 1563 - DNA, 23 bp, Artificial
  gRNA target site sequence
aggtgccagggcaccaggtgtgg

SEQ ID NO: 1564 - DNA, 23 bp, Artificial
  gRNA target site sequence
tcacgaggtgccagggcaccagg

SEQ ID NO: 1565 - DNA, 23 bp, Artificial
  gRNA target site sequence
cagcccatcacgaggtgccaggg

SEQ ID NO: 1566 - DNA, 23 bp, Artificial
  gRNA target site sequence
acagcccatcacgaggtgccagg

SEQ ID NO: 1567 - DNA, 23 bp, Artificial
  gRNA target site sequence
ccattccacagcccatcacgagg

SEQ ID NO: 1568 - DNA, 23 bp, Artificial
  gRNA target site sequence
gtcttggcaggcatagagctggg

SEQ ID NO: 1569 - DNA, 23 bp, Artificial
  gRNA target site sequence
ggtcttggcaggcatagagctgg

SEQ ID NO: 1570 - DNA, 23 bp, Artificial
  gRNA target site sequence
gaagatcgtggggtcttggcagg

SEQ ID NO: 1571 - DNA, 23 bp, Artificial
  gRNA target site sequence
cctcgaagatcgtggggtcttgg

SEQ ID NO: 1572 - DNA, 23 bp, Artificial
  gRNA target site sequence
gtctctcctcgaagatcgtgggg

SEQ ID NO: 1573 - DNA, 23 bp, Artificial
  gRNA target site sequence
tgtctctcctcgaagatcgtggg

SEQ ID NO: 1574 - DNA, 23 bp, Artificial
  gRNA target site sequence
gtgtctctcctcgaagatcgtgg

SEQ ID NO: 1575 - DNA, 23 bp, Artificial
  gRNA target site sequence
ccagctgtgagatgtacttgagg

SEQ ID NO: 1576 - DNA, 23 bp, Artificial
  gRNA target site sequence
tcagaaactccaattttatgagg

SEQ ID NO: 1577 - DNA, 23 bp, Artificial
  gRNA target site sequence
aactccaattttatgaggaccgg

SEQ ID NO: 1578 - DNA, 23 bp, Artificial
  gRNA target site sequence
tgaggaccggcagcagctgccgg

SEQ ID NO: 1579 - DNA, 23 bp, Artificial
  gRNA target site sequence
agcagctgccggcccccaagtgg

SEQ ID NO: 1580 - DNA, 23 bp, Artificial
  gRNA target site sequence
ggcccccaagtggacagagctgg

SEQ ID NO: 1581 - DNA, 23 bp, Artificial
  gRNA target site sequence
cctgctgattcaacagtgcatgg

SEQ ID NO: 1582 - DNA, 23 bp, Artificial
  gRNA target site sequence
acagtgcatggcctatgagccgg

SEQ ID NO: 1583 - DNA, 23 bp, Artificial
  gRNA target site sequence
tggcctatgagccggtccagagg

SEQ ID NO: 1584 - DNA, 23 bp, Artificial
  gRNA target site sequence
ctcaatagcctcatctcttcagg

SEQ ID NO: 1585 - DNA, 23 bp, Artificial
  gRNA target site sequence
tcatctcttcaggtgcccgctgg

SEQ ID NO: 1586 - DNA, 23 bp, Artificial
  gRNA target site sequence
catctcttcaggtgcccgctggg

SEQ ID NO: 1587 - DNA, 23 bp, Artificial
  gRNA target site sequence
tcttcaggtgcccgctgggacgg

SEQ ID NO: 1588 - DNA, 23 bp, Artificial
  gRNA target site sequence
cttcaggtgcccgctgggacggg

SEQ ID NO: 1589 - DNA, 23 bp, Artificial
  gRNA target site sequence
aggtgcccgctgggacgggttgg

SEQ ID NO: 1590 - DNA, 23 bp, Artificial
  gRNA target site sequence
ggtgcccgctgggacgggttggg

SEQ ID NO: 1591 - DNA, 23 bp, Artificial
  gRNA target site sequence
gcccgctgggacgggttgggtgg

SEQ ID NO: 1592 - DNA, 23 bp, Artificial
  gRNA target site sequence
ctgagggtgagaggagcagtcgg

SEQ ID NO: 1593 - DNA, 23 bp, Artificial
  gRNA target site sequence
ttggagtttctgagggtgagagg

SEQ ID NO: 1594 - DNA, 23 bp, Artificial
  gRNA target site sequence
cataaaattggagtttctgaggg

SEQ ID NO: 1595 - DNA, 23 bp, Artificial
  gRNA target site sequence
tcataaaattggagtttctgagg

SEQ ID NO: 1596 - DNA, 23 bp, Artificial
  gRNA target site sequence
gctgccggtcctcataaaattgg

SEQ ID NO: 1597 - DNA, 23 bp, Artificial
  gRNA target site sequence
tgggggccggcagctgctgccgg

SEQ ID NO: 1598 - DNA, 23 bp, Artificial
  gRNA target site sequence
agctctgtccacttgggggccgg

SEQ ID NO: 1599 - DNA, 23 bp, Artificial
  gRNA target site sequence
ggccagctctgtccacttggggg

SEQ ID NO: 1600 - DNA, 23 bp, Artificial
  gRNA target site sequence
gggccagctctgtccacttgggg

SEQ ID NO: 1601 - DNA, 23 bp, Artificial
  gRNA target site sequence
agggccagctctgtccacttggg

SEQ ID NO: 1602 - DNA, 23 bp, Artificial
  gRNA target site sequence
cagggccagctctgtccacttgg

SEQ ID NO: 1603 - DNA, 23 bp, Artificial
  gRNA target site sequence
catgcactgttgaatcagcaggg

SEQ ID NO: 1604 - DNA, 23 bp, Artificial
  gRNA target site sequence
ccatgcactgttgaatcagcagg

SEQ ID NO: 1605 - DNA, 23 bp, Artificial
  gRNA target site sequence
gggcctctggaccggctcatagg

SEQ ID NO: 1606 - DNA, 23 bp, Artificial
  gRNA target site sequence
cggaaggagggcctctggaccgg

SEQ ID NO: 1607 - DNA, 23 bp, Artificial
  gRNA target site sequence
cggctcggaaggagggcctctgg

SEQ ID NO: 1608 - DNA, 23 bp, Artificial
  gRNA target site sequence
cgaatgacggctcggaaggaggg

SEQ ID NO: 1609 - DNA, 23 bp, Artificial
  gRNA target site sequence
acgaatgacggctcggaaggagg

SEQ ID NO: 1610 - DNA, 23 bp, Artificial
  gRNA target site sequence
gtcacgaatgacggctcggaagg

SEQ ID NO: 1611 - DNA, 23 bp, Artificial
  gRNA target site sequence
tgaggtcacgaatgacggctcgg

SEQ ID NO: 1612 - DNA, 23 bp, Artificial
  gRNA target site sequence
gctattgaggtcacgaatgacgg

SEQ ID NO: 1613 - DNA, 23 bp, Artificial
  gRNA target site sequence
ctgaagagatgaggctattgagg

SEQ ID NO: 1614 - DNA, 23 bp, Artificial
  gRNA target site sequence
agcgggcacctgaagagatgagg

SEQ ID NO: 1615 - DNA, 23 bp, Artificial
  gRNA target site sequence
ttccctcagtgctcaccgacagg

SEQ ID NO: 1616 - DNA, 23 bp, Artificial
  gRNA target site sequence
tgctcaccgacaggatcccctgg

SEQ ID NO: 1617 - DNA, 23 bp, Artificial
  gRNA target site sequence
gctcaccgacaggatcccctggg

SEQ ID NO: 1618 - DNA, 23 bp, Artificial
  gRNA target site sequence
caccgacaggatcccctgggtgg

SEQ ID NO: 1619 - DNA, 23 bp, Artificial
  gRNA target site sequence
gggtggcccccgagtgtctccgg

SEQ ID NO: 1620 - DNA, 23 bp, Artificial
  gRNA target site sequence
ggtggcccccgagtgtctccggg

SEQ ID NO: 1621 - DNA, 23 bp, Artificial
  gRNA target site sequence
ggcccccgagtgtctccgggagg

SEQ ID NO: 1622 - DNA, 23 bp, Artificial
  gRNA target site sequence
ggaggcgcagacacttagcttgg

SEQ ID NO: 1623 - DNA, 23 bp, Artificial
  gRNA target site sequence
ttagcttggaagctgacaagtgg

SEQ ID NO: 1624 - DNA, 23 bp, Artificial
  gRNA target site sequence
tagcttggaagctgacaagtggg

SEQ ID NO: 1625 - DNA, 23 bp, Artificial
  gRNA target site sequence
agcttggaagctgacaagtgggg

SEQ ID NO: 1626 - DNA, 23 bp, Artificial
  gRNA target site sequence
gaagctgacaagtggggcttcgg

SEQ ID NO: 1627 - DNA, 23 bp, Artificial
  gRNA target site sequence
caagtggggcttcggcgccacgg

SEQ ID NO: 1628 - DNA, 23 bp, Artificial
  gRNA target site sequence
ggggcttcggcgccacggtctgg

SEQ ID NO: 1629 - DNA, 23 bp, Artificial
  gRNA target site sequence
gggcttcggcgccacggtctggg

SEQ ID NO: 1630 - DNA, 23 bp, Artificial
  gRNA target site sequence
acggtctgggaagtgtttagtgg

SEQ ID NO: 1631 - DNA, 23 bp, Artificial
  gRNA target site sequence
caccatgcccatcagtgccctgg

SEQ ID NO: 1632 - DNA, 23 bp, Artificial
  gRNA target site sequence
cagtgccctggatcctgctaagg

SEQ ID NO: 1633 - DNA, 23 bp, Artificial
  gRNA target site sequence
taaggtcagagcccctcacccgg

SEQ ID NO: 1634 - DNA, 23 bp, Artificial
  gRNA target site sequence
cagagcccctcacccggcatcgg

SEQ ID NO: 1635 - DNA, 23 bp, Artificial
  gRNA target site sequence
gagggaatgaaagtgggatcagg

SEQ ID NO: 1636 - DNA, 23 bp, Artificial
  gRNA target site sequence
agcactgagggaatgaaagtggg

SEQ ID NO: 1637 - DNA, 23 bp, Artificial
  gRNA target site sequence
gagcactgagggaatgaaagtgg

SEQ ID NO: 1638 - DNA, 23 bp, Artificial
  gRNA target site sequence
atcctgtcggtgagcactgaggg

SEQ ID NO: 1639 - DNA, 23 bp, Artificial
  gRNA target site sequence
gatcctgtcggtgagcactgagg

SEQ ID NO: 1640 - DNA, 23 bp, Artificial
  gRNA target site sequence
ggccacccaggggatcctgtcgg

SEQ ID NO: 1641 - DNA, 23 bp, Artificial
  gRNA target site sequence
gacactcgggggccacccagggg

SEQ ID NO: 1642 - DNA, 23 bp, Artificial
  gRNA target site sequence
agacactcgggggccacccaggg

SEQ ID NO: 1643 - DNA, 23 bp, Artificial
  gRNA target site sequence
gagacactcgggggccacccagg

SEQ ID NO: 1644 - DNA, 23 bp, Artificial
  gRNA target site sequence
cgcctcccggagacactcggggg

SEQ ID NO: 1645 - DNA, 23 bp, Artificial
  gRNA target site sequence
gcgcctcccggagacactcgggg

SEQ ID NO: 1646 - DNA, 23 bp, Artificial
  gRNA target site sequence
tgcgcctcccggagacactcggg

SEQ ID NO: 1647 - DNA, 23 bp, Artificial
  gRNA target site sequence
ctgcgcctcccggagacactcgg

SEQ ID NO: 1648 - DNA, 23 bp, Artificial
  gRNA target site sequence
agctaagtgtctgcgcctcccgg

SEQ ID NO: 1649 - DNA, 23 bp, Artificial
  gRNA target site sequence
actaaacacttcccagaccgtgg

SEQ ID NO: 1650 - DNA, 23 bp, Artificial
  gRNA target site sequence
atccagggcactgatgggcatgg

SEQ ID NO: 1651 - DNA, 23 bp, Artificial
  gRNA target site sequence
gcaggatccagggcactgatggg

SEQ ID NO: 1652 - DNA, 23 bp, Artificial
  gRNA target site sequence
agcaggatccagggcactgatgg

SEQ ID NO: 1653 - DNA, 23 bp, Artificial
  gRNA target site sequence
tctgaccttagcaggatccaggg

SEQ ID NO: 1654 - DNA, 23 bp, Artificial
  gRNA target site sequence
ctctgaccttagcaggatccagg

SEQ ID NO: 1655 - DNA, 23 bp, Artificial
  gRNA target site sequence
tgaggggctctgaccttagcagg

SEQ ID NO: 1656 - DNA, 23 bp, Artificial
  gRNA target site sequence
ttcctgtgtctggcccccttagg

SEQ ID NO: 1657 - DNA, 23 bp, Artificial
  gRNA target site sequence
ctgtgtctggcccccttaggagg

SEQ ID NO: 1658 - DNA, 23 bp, Artificial
  gRNA target site sequence
tggcccccttaggaggacaaagg

SEQ ID NO: 1659 - DNA, 23 bp, Artificial
  gRNA target site sequence
gaggacaaaggcctgccccatgg

SEQ ID NO: 1660 - DNA, 23 bp, Artificial
  gRNA target site sequence
cccatggcaatgtctctgcccgg

SEQ ID NO: 1661 - DNA, 23 bp, Artificial
  gRNA target site sequence
tggcaatgtctctgcccggaagg

SEQ ID NO: 1662 - DNA, 23 bp, Artificial
  gRNA target site sequence
ctctgcccggaaggtgctcctgg

SEQ ID NO: 1663 - DNA, 23 bp, Artificial
  gRNA target site sequence
cccggaaggtgctcctggctcgg

SEQ ID NO: 1664 - DNA, 23 bp, Artificial
  gRNA target site sequence
ccggaaggtgctcctggctcggg

SEQ ID NO: 1665 - DNA, 23 bp, Artificial
  gRNA target site sequence
gaaggtgctcctggctcgggagg

SEQ ID NO: 1666 - DNA, 23 bp, Artificial
  gRNA target site sequence
aaggtgctcctggctcgggaggg

SEQ ID NO: 1667 - DNA, 23 bp, Artificial
  gRNA target site sequence
aggtgctcctggctcgggagggg

SEQ ID NO: 1668 - DNA, 23 bp, Artificial
  gRNA target site sequence
ggtgctcctggctcgggaggggg

SEQ ID NO: 1669 - DNA, 23 bp, Artificial
  gRNA target site sequence
ctggctcgggagggggctgatgg

SEQ ID NO: 1670 - DNA, 23 bp, Artificial
  gRNA target site sequence
tggctcgggagggggctgatggg

SEQ ID NO: 1671 - DNA, 23 bp, Artificial
  gRNA target site sequence
ttcatcaagctgagtgaccctgg

SEQ ID NO: 1672 - DNA, 23 bp, Artificial
  gRNA target site sequence
tcatcaagctgagtgaccctggg

SEQ ID NO: 1673 - DNA, 23 bp, Artificial
  gRNA target site sequence
catcaagctgagtgaccctgggg

SEQ ID NO: 1674 - DNA, 23 bp, Artificial
  gRNA target site sequence
cagccccgctgtgttaagcctgg

SEQ ID NO: 1675 - DNA, 23 bp, Artificial
  gRNA target site sequence
aagcctggagagtaagttcctgg

SEQ ID NO: 1676 - DNA, 23 bp, Artificial
  gRNA target site sequence
cctggagagtaagttcctggagg

SEQ ID NO: 1677 - DNA, 23 bp, Artificial
  gRNA target site sequence
ggagagtaagttcctggaggtgg

SEQ ID NO: 1678 - DNA, 23 bp, Artificial
  gRNA target site sequence
gagtaagttcctggaggtggagg

SEQ ID NO: 1679 - DNA, 23 bp, Artificial
  gRNA target site sequence
taagttcctggaggtggaggagg

SEQ ID NO: 1680 - DNA, 23 bp, Artificial
  gRNA target site sequence
aagttcctggaggtggaggaggg

SEQ ID NO: 1681 - DNA, 23 bp, Artificial
  gRNA target site sequence
ctcctaagggggccagacacagg

SEQ ID NO: 1682 - DNA, 23 bp, Artificial
  gRNA target site sequence
aggcctttgtcctcctaaggggg

SEQ ID NO: 1683 - DNA, 23 bp, Artificial
  gRNA target site sequence
caggcctttgtcctcctaagggg

SEQ ID NO: 1684 - DNA, 23 bp, Artificial
  gRNA target site sequence
gcaggcctttgtcctcctaaggg

SEQ ID NO: 1685 - DNA, 23 bp, Artificial
  gRNA target site sequence
ggcaggcctttgtcctcctaagg

SEQ ID NO: 1686 - DNA, 23 bp, Artificial
  gRNA target site sequence
cagagacattgccatggggcagg

SEQ ID NO: 1687 - DNA, 23 bp, Artificial
  gRNA target site sequence
cgggcagagacattgccatgggg

SEQ ID NO: 1688 - DNA, 23 bp, Artificial
  gRNA target site sequence
ccgggcagagacattgccatggg

SEQ ID NO: 1689 - DNA, 23 bp, Artificial
  gRNA target site sequence
tccgggcagagacattgccatgg

SEQ ID NO: 1690 - DNA, 23 bp, Artificial
  gRNA target site sequence
ccgagccaggagcaccttccggg

SEQ ID NO: 1691 - DNA, 23 bp, Artificial
  gRNA target site sequence
cccgagccaggagcaccttccgg

SEQ ID NO: 1692 - DNA, 23 bp, Artificial
  gRNA target site sequence
catcagccccctcccgagccagg

SEQ ID NO: 1693 - DNA, 23 bp, Artificial
  gRNA target site sequence
cactcagcttgatgaagggcggg

SEQ ID NO: 1694 - DNA, 23 bp, Artificial
  gRNA target site sequence
tcactcagcttgatgaagggcgg

SEQ ID NO: 1695 - DNA, 23 bp, Artificial
  gRNA target site sequence
gggtcactcagcttgatgaaggg

SEQ ID NO: 1696 - DNA, 23 bp, Artificial
  gRNA target site sequence
agggtcactcagcttgatgaagg

SEQ ID NO: 1697 - DNA, 23 bp, Artificial
  gRNA target site sequence
acacagcggggctgaccccaggg

SEQ ID NO: 1698 - DNA, 23 bp, Artificial
  gRNA target site sequence
aacacagcggggctgaccccagg

SEQ ID NO: 1699 - DNA, 23 bp, Artificial
  gRNA target site sequence
tctccaggcttaacacagcgggg

SEQ ID NO: 1700 - DNA, 23 bp, Artificial
  gRNA target site sequence
ctctccaggcttaacacagcggg

SEQ ID NO: 1701 - DNA, 23 bp, Artificial
  gRNA target site sequence
actctccaggcttaacacagcgg

SEQ ID NO: 1702 - DNA, 23 bp, Artificial
  gRNA target site sequence
cctccaggaacttactctccagg

SEQ ID NO: 1703 - DNA, 23 bp, Artificial
  gRNA target site sequence
gcctctccctgctgccaaccagg

SEQ ID NO: 1704 - DNA, 23 bp, Artificial
  gRNA target site sequence
ctgctgccaaccaggcaccatgg

SEQ ID NO: 1705 - DNA, 23 bp, Artificial
  gRNA target site sequence
ccaaccaggcaccatggtgcagg

SEQ ID NO: 1706 - DNA, 23 bp, Artificial
  gRNA target site sequence
ggtgcaggaatttgtacacctgg

SEQ ID NO: 1707 - DNA, 23 bp, Artificial
  gRNA target site sequence
gtgcaggaatttgtacacctggg

SEQ ID NO: 1708 - DNA, 23 bp, Artificial
  gRNA target site sequence
tgcaggaatttgtacacctgggg

SEQ ID NO: 1709 - DNA, 23 bp, Artificial
  gRNA target site sequence
gcaggaatttgtacacctggggg

SEQ ID NO: 1710 - DNA, 23 bp, Artificial
  gRNA target site sequence
gacatgtatctgcgaaaacgtgg

SEQ ID NO: 1711 - DNA, 23 bp, Artificial
  gRNA target site sequence
tctgcgaaaacgtggccacctgg

SEQ ID NO: 1712 - DNA, 23 bp, Artificial
  gRNA target site sequence
gccacctggtgccagccagctgg

SEQ ID NO: 1713 - DNA, 23 bp, Artificial
  gRNA target site sequence
gccagccagctggaagctgcagg

SEQ ID NO: 1714 - DNA, 23 bp, Artificial
  gRNA target site sequence
agccagctggaagctgcaggtgg

SEQ ID NO: 1715 - DNA, 23 bp, Artificial
  gRNA target site sequence
gctgcaggtggtcaaacagctgg

SEQ ID NO: 1716 - DNA, 23 bp, Artificial
  gRNA target site sequence
ggcctacgccctcaactatctgg

SEQ ID NO: 1717 - DNA, 23 bp, Artificial
  gRNA target site sequence
ggttggcagcagggagaggcggg

SEQ ID NO: 1718 - DNA, 23 bp, Artificial
  gRNA target site sequence
tggttggcagcagggagaggcgg

SEQ ID NO: 1719 - DNA, 23 bp, Artificial
  gRNA target site sequence
gcctggttggcagcagggagagg

SEQ ID NO: 1720 - DNA, 23 bp, Artificial
  gRNA target site sequence
atggtgcctggttggcagcaggg

SEQ ID NO: 1721 - DNA, 23 bp, Artificial
  gRNA target site sequence
catggtgcctggttggcagcagg

SEQ ID NO: 1722 - DNA, 23 bp, Artificial
  gRNA target site sequence
cctgcaccatggtgcctggttgg

SEQ ID NO: 1723 - DNA, 23 bp, Artificial
  gRNA target site sequence
aattcctgcaccatggtgcctgg

SEQ ID NO: 1724 - DNA, 23 bp, Artificial
  gRNA target site sequence
gtgtacaaattcctgcaccatgg

SEQ ID NO: 1725 - DNA, 23 bp, Artificial
  gRNA target site sequence
gatacatgtctatggcccccagg

SEQ ID NO: 1726 - DNA, 23 bp, Artificial
  gRNA target site sequence
ttttcgcagatacatgtctatgg

SEQ ID NO: 1727 - DNA, 23 bp, Artificial
  gRNA target site sequence
tccagctggctggcaccaggtgg

SEQ ID NO: 1728 - DNA, 23 bp, Artificial
  gRNA target site sequence
gcttccagctggctggcaccagg

SEQ ID NO: 1729 - DNA, 23 bp, Artificial
  gRNA target site sequence
acctgcagcttccagctggctgg

SEQ ID NO: 1730 - DNA, 23 bp, Artificial
  gRNA target site sequence
gaccacctgcagcttccagctgg

SEQ ID NO: 1731 - DNA, 23 bp, Artificial
  gRNA target site sequence
caccagatagttgagggcgtagg

SEQ ID NO: 1732 - DNA, 23 bp, Artificial
  gRNA target site sequence
agcactcaccagatagttgaggg

SEQ ID NO: 1733 - DNA, 23 bp, Artificial
  gRNA target site sequence
gagcactcaccagatagttgagg

SEQ ID NO: 1734 - DNA, 23 bp, Artificial
  gRNA target site sequence
ccaccttccccagtcattcctgg

SEQ ID NO: 1735 - DNA, 23 bp, Artificial
  gRNA target site sequence
tgatgagccaagtgtcgtaccgg

SEQ ID NO: 1736 - DNA, 23 bp, Artificial
  gRNA target site sequence
cggcatctcgtgctgctccacgg

SEQ ID NO: 1737 - DNA, 23 bp, Artificial
  gRNA target site sequence
gctgctccacggcgtgtgcatgg

SEQ ID NO: 1738 - DNA, 23 bp, Artificial
  gRNA target site sequence
ctccacggcgtgtgcatggctgg

SEQ ID NO: 1739 - DNA, 23 bp, Artificial
  gRNA target site sequence
atgactggggaaggtgggaaggg

SEQ ID NO: 1740 - DNA, 23 bp, Artificial
  gRNA target site sequence
aatgactggggaaggtgggaagg

SEQ ID NO: 1741 - DNA, 23 bp, Artificial
  gRNA target site sequence
caggaatgactggggaaggtggg

SEQ ID NO: 1742 - DNA, 23 bp, Artificial
  gRNA target site sequence
ccaggaatgactggggaaggtgg

SEQ ID NO: 1743 - DNA, 23 bp, Artificial
  gRNA target site sequence
cttccaggaatgactggggaagg

SEQ ID NO: 1744 - DNA, 23 bp, Artificial
  gRNA target site sequence
gctgcttccaggaatgactgggg

SEQ ID NO: 1745 - DNA, 23 bp, Artificial
  gRNA target site sequence
cgctgcttccaggaatgactggg

SEQ ID NO: 1746 - DNA, 23 bp, Artificial
  gRNA target site sequence
tcgctgcttccaggaatgactgg

SEQ ID NO: 1747 - DNA, 23 bp, Artificial
  gRNA target site sequence
tcatcaagctcgctgcttccagg

SEQ ID NO: 1748 - DNA, 23 bp, Artificial
  gRNA target site sequence
cgagatgccggtacgacacttgg

SEQ ID NO: 1749 - DNA, 23 bp, Artificial
  gRNA target site sequence
cgtggagcagcacgagatgccgg

SEQ ID NO: 1750 - DNA, 23 bp, Artificial
  gRNA target site sequence
ctccagccatgcacacgccgtgg

SEQ ID NO: 1751 - DNA, 23 bp, Artificial
  gRNA target site sequence
caccattcagcatgagaacctgg

SEQ ID NO: 1752 - DNA, 23 bp, Artificial
  gRNA target site sequence
accattcagcatgagaacctggg

SEQ ID NO: 1753 - DNA, 23 bp, Artificial
  gRNA target site sequence
cagcatgagaacctgggccatgg

SEQ ID NO: 1754 - DNA, 23 bp, Artificial
  gRNA target site sequence
agcatgagaacctgggccatggg

SEQ ID NO: 1755 - DNA, 23 bp, Artificial
  gRNA target site sequence
ggtccttcaccaagatttaccgg

SEQ ID NO: 1756 - DNA, 23 bp, Artificial
  gRNA target site sequence
gtccttcaccaagatttaccggg

SEQ ID NO: 1757 - DNA, 23 bp, Artificial
  gRNA target site sequence
tccttcaccaagatttaccgggg

SEQ ID NO: 1758 - DNA, 23 bp, Artificial
  gRNA target site sequence
ttaccggggctgtcgccatgagg

SEQ ID NO: 1759 - DNA, 23 bp, Artificial
  gRNA target site sequence
ccggggctgtcgccatgaggtgg

SEQ ID NO: 1760 - DNA, 23 bp, Artificial
  gRNA target site sequence
gggctgtcgccatgaggtggtgg

SEQ ID NO: 1761 - DNA, 23 bp, Artificial
  gRNA target site sequence
tgtcgccatgaggtggtggatgg

SEQ ID NO: 1762 - DNA, 23 bp, Artificial
  gRNA target site sequence
gtcgccatgaggtggtggatggg

SEQ ID NO: 1763 - DNA, 23 bp, Artificial
  gRNA target site sequence
tcgccatgaggtggtggatgggg

SEQ ID NO: 1764 - DNA, 23 bp, Artificial
  gRNA target site sequence
ccatgaggtggtggatggggagg

SEQ ID NO: 1765 - DNA, 23 bp, Artificial
  gRNA target site sequence
tggggaggcccgaaagacagagg

SEQ ID NO: 1766 - DNA, 23 bp, Artificial
  gRNA target site sequence
aaagacagaggtgctgctgaagg

SEQ ID NO: 1767 - DNA, 23 bp, Artificial
  gRNA target site sequence
agaggtgctgctgaaggtcatgg

SEQ ID NO: 1768 - DNA, 23 bp, Artificial
  gRNA target site sequence
tgccaagcacaagaactgcatgg

SEQ ID NO: 1769 - DNA, 23 bp, Artificial
  gRNA target site sequence
caagcacaagaactgcatggagg

SEQ ID NO: 1770 - DNA, 23 bp, Artificial
  gRNA target site sequence
gcatggaggtgagagcaatgtgg

SEQ ID NO: 1771 - DNA, 23 bp, Artificial
  gRNA target site sequence
ttctcatgctgaatggtgagggg

SEQ ID NO: 1772 - DNA, 23 bp, Artificial
  gRNA target site sequence
gttctcatgctgaatggtgaggg

SEQ ID NO: 1773 - DNA, 23 bp, Artificial
  gRNA target site sequence
ggttctcatgctgaatggtgagg

SEQ ID NO: 1774 - DNA, 23 bp, Artificial
  gRNA target site sequence
gcccaggttctcatgctgaatgg

SEQ ID NO: 1775 - DNA, 23 bp, Artificial
  gRNA target site sequence
tggtgaaggacccatggcccagg

SEQ ID NO: 1776 - DNA, 23 bp, Artificial
  gRNA target site sequence
aaatcttggtgaaggacccatgg

SEQ ID NO: 1777 - DNA, 23 bp, Artificial
  gRNA target site sequence
gccccggtaaatcttggtgaagg

SEQ ID NO: 1778 - DNA, 23 bp, Artificial
  gRNA target site sequence
gcgacagccccggtaaatcttgg

SEQ ID NO: 1779 - DNA, 23 bp, Artificial
  gRNA target site sequence
ccacctcatggcgacagccccgg

SEQ ID NO: 1780 - DNA, 23 bp, Artificial
  gRNA target site sequence
cctccccatccaccacctcatgg

SEQ ID NO: 1781 - DNA, 23 bp, Artificial
  gRNA target site sequence
cagcagcacctctgtctttcggg

SEQ ID NO: 1782 - DNA, 23 bp, Artificial
  gRNA target site sequence
tcagcagcacctctgtctttcgg

SEQ ID NO: 1783 - DNA, 23 bp, Artificial
  gRNA target site sequence
ctccatgcagttcttgtgcttgg

SEQ ID NO: 1784 - DNA, 23 bp, Artificial
  gRNA target site sequence
agaaaagtccaacctgatcgtgg

SEQ ID NO: 1785 - DNA, 23 bp, Artificial
  gRNA target site sequence
aacctgatcgtggtccagagagg

SEQ ID NO: 1786 - DNA, 23 bp, Artificial
  gRNA target site sequence
cagcccacccacatcatccttgg

SEQ ID NO: 1787 - DNA, 23 bp, Artificial
  gRNA target site sequence
caagatccctgctgacagcctgg

SEQ ID NO: 1788 - DNA, 23 bp, Artificial
  gRNA target site sequence
tccctgctgacagcctggagtgg

SEQ ID NO: 1789 - DNA, 23 bp, Artificial
  gRNA target site sequence
ccctgctgacagcctggagtggg

SEQ ID NO: 1790 - DNA, 23 bp, Artificial
  gRNA target site sequence
gacagcctggagtgggtaagagg

SEQ ID NO: 1791 - DNA, 23 bp, Artificial
  gRNA target site sequence
ctggagtgggtaagaggccctgg

SEQ ID NO: 1792 - DNA, 23 bp, Artificial
  gRNA target site sequence
tggagtgggtaagaggccctggg

SEQ ID NO: 1793 - DNA, 23 bp, Artificial
  gRNA target site sequence
gtaagaggccctgggaaatgagg

SEQ ID NO: 1794 - DNA, 23 bp, Artificial
  gRNA target site sequence
tttctatggggagaggatgaggg

SEQ ID NO: 1795 - DNA, 23 bp, Artificial
  gRNA target site sequence
ttttctatggggagaggatgagg

SEQ ID NO: 1796 - DNA, 23 bp, Artificial
  gRNA target site sequence
ttggacttttctatggggagagg

SEQ ID NO: 1797 - DNA, 23 bp, Artificial
  gRNA target site sequence
tcaggttggacttttctatgggg

SEQ ID NO: 1798 - DNA, 23 bp, Artificial
  gRNA target site sequence
atcaggttggacttttctatggg

SEQ ID NO: 1799 - DNA, 23 bp, Artificial
  gRNA target site sequence
gatcaggttggacttttctatgg

SEQ ID NO: 1800 - DNA, 23 bp, Artificial
  gRNA target site sequence
tctctggaccacgatcaggttgg

SEQ ID NO: 1801 - DNA, 23 bp, Artificial
  gRNA target site sequence
gacctctctggaccacgatcagg

SEQ ID NO: 1802 - DNA, 23 bp, Artificial
  gRNA target site sequence
tgggtgggctgtgacctctctgg

SEQ ID NO: 1803 - DNA, 23 bp, Artificial
  gRNA target site sequence
gaaccaaggatgatgtgggtggg

SEQ ID NO: 1804 - DNA, 23 bp, Artificial
  gRNA target site sequence
tgaaccaaggatgatgtgggtgg

SEQ ID NO: 1805 - DNA, 23 bp, Artificial
  gRNA target site sequence
ggctgaaccaaggatgatgtggg

SEQ ID NO: 1806 - DNA, 23 bp, Artificial
  gRNA target site sequence
gggctgaaccaaggatgatgtgg

SEQ ID NO: 1807 - DNA, 23 bp, Artificial
  gRNA target site sequence
ttgggattggggctgaaccaagg

SEQ ID NO: 1808 - DNA, 23 bp, Artificial
  gRNA target site sequence
ctcagctggtattgggattgggg

SEQ ID NO: 1809 - DNA, 23 bp, Artificial
  gRNA target site sequence
actcagctggtattgggattggg

SEQ ID NO: 1810 - DNA, 23 bp, Artificial
  gRNA target site sequence
gactcagctggtattgggattgg

SEQ ID NO: 1811 - DNA, 23 bp, Artificial
  gRNA target site sequence
catctgactcagctggtattggg

SEQ ID NO: 1812 - DNA, 23 bp, Artificial
  gRNA target site sequence
tcatctgactcagctggtattgg

SEQ ID NO: 1813 - DNA, 23 bp, Artificial
  gRNA target site sequence
gaaatgtcatctgactcagctgg

SEQ ID NO: 1814 - DNA, 23 bp, Artificial
  gRNA target site sequence
cccactccaggctgtcagcaggg

SEQ ID NO: 1815 - DNA, 23 bp, Artificial
  gRNA target site sequence
acccactccaggctgtcagcagg

SEQ ID NO: 1816 - DNA, 23 bp, Artificial
  gRNA target site sequence
cagggcctcttacccactccagg

SEQ ID NO: 1817 - DNA, 23 bp, Artificial
  gRNA target site sequence
tcttctttgcagaacccccttgg

SEQ ID NO: 1818 - DNA, 23 bp, Artificial
  gRNA target site sequence
cccccttggtcctgattataagg

SEQ ID NO: 1819 - DNA, 23 bp, Artificial
  gRNA target site sequence
ccccttggtcctgattataaggg

SEQ ID NO: 1820 - DNA, 23 bp, Artificial
  gRNA target site sequence
attataagggctgcctcatccgg

SEQ ID NO: 1821 - DNA, 23 bp, Artificial
  gRNA target site sequence
ctcatccggcgcagccccacagg

SEQ ID NO: 1822 - DNA, 23 bp, Artificial
  gRNA target site sequence
ccccacaggaaccttccttctgg

SEQ ID NO: 1823 - DNA, 23 bp, Artificial
  gRNA target site sequence
acaggaaccttccttctggttgg

SEQ ID NO: 1824 - DNA, 23 bp, Artificial
  gRNA target site sequence
cagcagtcttcgagagctcctgg

SEQ ID NO: 1825 - DNA, 23 bp, Artificial
  gRNA target site sequence
gagagctcctggcaacctgctgg

SEQ ID NO: 1826 - DNA, 23 bp, Artificial
  gRNA target site sequence
agagctcctggcaacctgctggg

SEQ ID NO: 1827 - DNA, 23 bp, Artificial
  gRNA target site sequence
ctcctggcaacctgctgggatgg

SEQ ID NO: 1828 - DNA, 23 bp, Artificial
  gRNA target site sequence
tcctggcaacctgctgggatggg

SEQ ID NO: 1829 - DNA, 23 bp, Artificial
  gRNA target site sequence
cctggcaacctgctgggatgggg

SEQ ID NO: 1830 - DNA, 23 bp, Artificial
  gRNA target site sequence
ctggcaacctgctgggatggggg

SEQ ID NO: 1831 - DNA, 23 bp, Artificial
  gRNA target site sequence
tggcaacctgctgggatgggggg

SEQ ID NO: 1832 - DNA, 23 bp, Artificial
  gRNA target site sequence
gatggggggctgcacgtagatgg

SEQ ID NO: 1833 - DNA, 23 bp, Artificial
  gRNA target site sequence
atggggggctgcacgtagatggg

SEQ ID NO: 1834 - DNA, 23 bp, Artificial
  gRNA target site sequence
tggggggctgcacgtagatgggg

SEQ ID NO: 1835 - DNA, 23 bp, Artificial
  gRNA target site sequence
ggggctgcacgtagatggggtgg

SEQ ID NO: 1836 - DNA, 23 bp, Artificial
  gRNA target site sequence
tgctgtatccccagacccaaagg

SEQ ID NO: 1837 - DNA, 23 bp, Artificial
  gRNA target site sequence
aggtgagccccttcctcccctgg

SEQ ID NO: 1838 - DNA, 23 bp, Artificial
  gRNA target site sequence
gggggttctgcaaagaagagtgg

SEQ ID NO: 1839 - DNA, 23 bp, Artificial
  gRNA target site sequence
ccttataatcaggaccaaggggg

SEQ ID NO: 1840 - DNA, 23 bp, Artificial
  gRNA target site sequence
cccttataatcaggaccaagggg

SEQ ID NO: 1841 - DNA, 23 bp, Artificial
  gRNA target site sequence
gcccttataatcaggaccaaggg

SEQ ID NO: 1842 - DNA, 23 bp, Artificial
  gRNA target site sequence
agcccttataatcaggaccaagg

SEQ ID NO: 1843 - DNA, 23 bp, Artificial
  gRNA target site sequence
atgaggcagcccttataatcagg

SEQ ID NO: 1844 - DNA, 23 bp, Artificial
  gRNA target site sequence
ctgtggggctgcgccggatgagg

SEQ ID NO: 1845 - DNA, 23 bp, Artificial
  gRNA target site sequence
aggttcctgtggggctgcgccgg

SEQ ID NO: 1846 - DNA, 23 bp, Artificial
  gRNA target site sequence
ccagaaggaaggttcctgtgggg

SEQ ID NO: 1847 - DNA, 23 bp, Artificial
  gRNA target site sequence
accagaaggaaggttcctgtggg

SEQ ID NO: 1848 - DNA, 23 bp, Artificial
  gRNA target site sequence
aaccagaaggaaggttcctgtgg

SEQ ID NO: 1849 - DNA, 23 bp, Artificial
  gRNA target site sequence
gctgaggccaaccagaaggaagg

SEQ ID NO: 1850 - DNA, 23 bp, Artificial
  gRNA target site sequence
gtcggctgaggccaaccagaagg

SEQ ID NO: 1851 - DNA, 23 bp, Artificial
  gRNA target site sequence
gactgctgtggggtcggctgagg

SEQ ID NO: 1852 - DNA, 23 bp, Artificial
  gRNA target site sequence
ctcgaagactgctgtggggtcgg

SEQ ID NO: 1853 - DNA, 23 bp, Artificial
  gRNA target site sequence
agctctcgaagactgctgtgggg

SEQ ID NO: 1854 - DNA, 23 bp, Artificial
  gRNA target site sequence
gagctctcgaagactgctgtggg

SEQ ID NO: 1855 - DNA, 23 bp, Artificial
  gRNA target site sequence
ggagctctcgaagactgctgtgg

SEQ ID NO: 1856 - DNA, 23 bp, Artificial
  gRNA target site sequence
ccccatcccagcaggttgccagg

SEQ ID NO: 1857 - DNA, 23 bp, Artificial
  gRNA target site sequence
gtgcagccccccatcccagcagg

SEQ ID NO: 1858 - DNA, 23 bp, Artificial
  gRNA target site sequence
ggggatacagcaggaagtgaggg

SEQ ID NO: 1859 - DNA, 23 bp, Artificial
  gRNA target site sequence
tggggatacagcaggaagtgagg

SEQ ID NO: 1860 - DNA, 23 bp, Artificial
  gRNA target site sequence
tttgggtctggggatacagcagg

SEQ ID NO: 1861 - DNA, 23 bp, Artificial
  gRNA target site sequence
ggggctcacctttgggtctgggg

SEQ ID NO: 1862 - DNA, 23 bp, Artificial
  gRNA target site sequence
aggggctcacctttgggtctggg

SEQ ID NO: 1863 - DNA, 23 bp, Artificial
  gRNA target site sequence
aaggggctcacctttgggtctgg

SEQ ID NO: 1864 - DNA, 23 bp, Artificial
  gRNA target site sequence
ggaggaaggggctcacctttggg

SEQ ID NO: 1865 - DNA, 23 bp, Artificial
  gRNA target site sequence
gggaggaaggggctcacctttgg

SEQ ID NO: 1866 - DNA, 23 bp, Artificial
  gRNA target site sequence
tctcaccttcccccacagtctgg

SEQ ID NO: 1867 - DNA, 23 bp, Artificial
  gRNA target site sequence
gccatcaacaagctcaagactgg

SEQ ID NO: 1868 - DNA, 23 bp, Artificial
  gRNA target site sequence
ccatcaacaagctcaagactggg

SEQ ID NO: 1869 - DNA, 23 bp, Artificial
  gRNA target site sequence
catcaacaagctcaagactgggg

SEQ ID NO: 1870 - DNA, 23 bp, Artificial
  gRNA target site sequence
atcaacaagctcaagactggggg

SEQ ID NO: 1871 - DNA, 23 bp, Artificial
  gRNA target site sequence
aagactgggggctcacgtcctgg

SEQ ID NO: 1872 - DNA, 23 bp, Artificial
  gRNA target site sequence
tgttctccgccgcagcccccagg

SEQ ID NO: 1873 - DNA, 23 bp, Artificial
  gRNA target site sequence
cctcctcactgtctgtgtccagg

SEQ ID NO: 1874 - DNA, 23 bp, Artificial
  gRNA target site sequence
ctcactgtctgtgtccaggtcgg

SEQ ID NO: 1875 - DNA, 23 bp, Artificial
  gRNA target site sequence
gtccaggtcggtctactgctagg

SEQ ID NO: 1876 - DNA, 23 bp, Artificial
  gRNA target site sequence
tccaggtcggtctactgctaggg

SEQ ID NO: 1877 - DNA, 23 bp, Artificial
  gRNA target site sequence
aggtcggtctactgctagggtgg

SEQ ID NO: 1878 - DNA, 23 bp, Artificial
  gRNA target site sequence
ggtcggtctactgctagggtggg

SEQ ID NO: 1879 - DNA, 23 bp, Artificial
  gRNA target site sequence
gactgtgggggaaggtgagaggg

SEQ ID NO: 1880 - DNA, 23 bp, Artificial
  gRNA target site sequence
agactgtgggggaaggtgagagg

SEQ ID NO: 1881 - DNA, 23 bp, Artificial
  gRNA target site sequence
aaagtccagactgtgggggaagg

SEQ ID NO: 1882 - DNA, 23 bp, Artificial
  gRNA target site sequence
tggcaaagtccagactgtggggg

SEQ ID NO: 1883 - DNA, 23 bp, Artificial
  gRNA target site sequence
atggcaaagtccagactgtgggg

SEQ ID NO: 1884 - DNA, 23 bp, Artificial
  gRNA target site sequence
gatggcaaagtccagactgtggg

SEQ ID NO: 1885 - DNA, 23 bp, Artificial
  gRNA target site sequence
tgatggcaaagtccagactgtgg

SEQ ID NO: 1886 - DNA, 23 bp, Artificial
  gRNA target site sequence
cccagtcttgagcttgttgatgg

SEQ ID NO: 1887 - DNA, 23 bp, Artificial
  gRNA target site sequence
cggcggagaacataggagccagg

SEQ ID NO: 1888 - DNA, 23 bp, Artificial
  gRNA target site sequence
ggggctgcggcggagaacatagg

SEQ ID NO: 1889 - DNA, 23 bp, Artificial
  gRNA target site sequence
caaagtcctgggggctgcggcgg

SEQ ID NO: 1890 - DNA, 23 bp, Artificial
  gRNA target site sequence
tgtcaaagtcctgggggctgcgg

SEQ ID NO: 1891 - DNA, 23 bp, Artificial
  gRNA target site sequence
ggaagctgtcaaagtcctggggg

SEQ ID NO: 1892 - DNA, 23 bp, Artificial
  gRNA target site sequence
aggaagctgtcaaagtcctgggg

SEQ ID NO: 1893 - DNA, 23 bp, Artificial
  gRNA target site sequence
gaggaagctgtcaaagtcctggg

SEQ ID NO: 1894 - DNA, 23 bp, Artificial
  gRNA target site sequence
ggaggaagctgtcaaagtcctgg

SEQ ID NO: 1895 - DNA, 23 bp, Artificial
  gRNA target site sequence
cctggacacagacagtgaggagg

SEQ ID NO: 1896 - DNA, 23 bp, Artificial
  gRNA target site sequence
cgacctggacacagacagtgagg

SEQ ID NO: 1897 - DNA, 23 bp, Artificial
  gRNA target site sequence
accctagcagtagaccgacctgg

SEQ ID NO: 1898 - DNA, 23 bp, Artificial
  gRNA target site sequence
ctctgacgcttgtccctcgcagg

SEQ ID NO: 1899 - DNA, 23 bp, Artificial
  gRNA target site sequence
tgacgcttgtccctcgcaggagg

SEQ ID NO: 1900 - DNA, 23 bp, Artificial
  gRNA target site sequence
tcgcaggaggccgagttcccagg

SEQ ID NO: 1901 - DNA, 23 bp, Artificial
  gRNA target site sequence
cgcaggaggccgagttcccaggg

SEQ ID NO: 1902 - DNA, 23 bp, Artificial
  gRNA target site sequence
cgagttcccagggctgcccgagg

SEQ ID NO: 1903 - DNA, 23 bp, Artificial
  gRNA target site sequence
gcccgaggctctgtcgttcgtgg

SEQ ID NO: 1904 - DNA, 23 bp, Artificial
  gRNA target site sequence
tctgtcgttcgtggcgctcgtgg

SEQ ID NO: 1905 - DNA, 23 bp, Artificial
  gRNA target site sequence
tcgttcgtggcgctcgtggacgg

SEQ ID NO: 1906 - DNA, 23 bp, Artificial
  gRNA target site sequence
cgctcgtggacggctacttccgg

SEQ ID NO: 1907 - DNA, 23 bp, Artificial
  gRNA target site sequence
cggctacttccggctgaccacgg

SEQ ID NO: 1908 - DNA, 23 bp, Artificial
  gRNA target site sequence
ctcccagcacttcttctgcaagg

SEQ ID NO: 1909 - DNA, 23 bp, Artificial
  gRNA target site sequence
ccagcacttcttctgcaaggagg

SEQ ID NO: 1910 - DNA, 23 bp, Artificial
  gRNA target site sequence
gcacttcttctgcaaggaggtgg

SEQ ID NO: 1911 - DNA, 23 bp, Artificial
  gRNA target site sequence
gcaaggaggtggcaccgccgagg

SEQ ID NO: 1912 - DNA, 23 bp, Artificial
  gRNA target site sequence
ggtggcaccgccgaggctgctgg

SEQ ID NO: 1913 - DNA, 23 bp, Artificial
  gRNA target site sequence
ggcaccgccgaggctgctggagg

SEQ ID NO: 1914 - DNA, 23 bp, Artificial
  gRNA target site sequence
gccgaggctgctggaggaagtgg

SEQ ID NO: 1915 - DNA, 23 bp, Artificial
  gRNA target site sequence
gaagtggccgagcagtgccacgg

SEQ ID NO: 1916 - DNA, 23 bp, Artificial
  gRNA target site sequence
tgccacggccccatcacgtaagg

SEQ ID NO: 1917 - DNA, 23 bp, Artificial
  gRNA target site sequence
aaggacctgtcccccattcccgg

SEQ ID NO: 1918 - DNA, 23 bp, Artificial
  gRNA target site sequence
gggaactcggcctcctgcgaggg

SEQ ID NO: 1919 - DNA, 23 bp, Artificial
  gRNA target site sequence
tgggaactcggcctcctgcgagg

SEQ ID NO: 1920 - DNA, 23 bp, Artificial
  gRNA target site sequence
ctcgggcagccctgggaactcgg

SEQ ID NO: 1921 - DNA, 23 bp, Artificial
  gRNA target site sequence
acagagcctcgggcagccctggg

SEQ ID NO: 1922 - DNA, 23 bp, Artificial
  gRNA target site sequence
gacagagcctcgggcagccctgg

SEQ ID NO: 1923 - DNA, 23 bp, Artificial
  gRNA target site sequence
gccacgaacgacagagcctcggg

SEQ ID NO: 1924 - DNA, 23 bp, Artificial
  gRNA target site sequence
cgccacgaacgacagagcctcgg

SEQ ID NO: 1925 - DNA, 23 bp, Artificial
  gRNA target site sequence
gctgggagtccgtggtcagccgg

SEQ ID NO: 1926 - DNA, 23 bp, Artificial
  gRNA target site sequence
gaagaagtgctgggagtccgtgg

SEQ ID NO: 1927 - DNA, 23 bp, Artificial
  gRNA target site sequence
ctccttgcagaagaagtgctggg

SEQ ID NO: 1928 - DNA, 23 bp, Artificial
  gRNA target site sequence
cctccttgcagaagaagtgctgg

SEQ ID NO: 1929 - DNA, 23 bp, Artificial
  gRNA target site sequence
acttcctccagcagcctcggcgg

SEQ ID NO: 1930 - DNA, 23 bp, Artificial
  gRNA target site sequence
gccacttcctccagcagcctcgg

SEQ ID NO: 1931 - DNA, 23 bp, Artificial
  gRNA target site sequence
gatggggccgtggcactgctcgg

SEQ ID NO: 1932 - DNA, 23 bp, Artificial
  gRNA target site sequence
gtccttacgtgatggggccgtgg

SEQ ID NO: 1933 - DNA, 23 bp, Artificial
  gRNA target site sequence
ggacaggtccttacgtgatgggg

SEQ ID NO: 1934 - DNA, 23 bp, Artificial
  gRNA target site sequence
gggacaggtccttacgtgatggg

SEQ ID NO: 1935 - DNA, 23 bp, Artificial
  gRNA target site sequence
ggggacaggtccttacgtgatgg

SEQ ID NO: 1936 - DNA, 23 bp, Artificial
  gRNA target site sequence
cggtactccccctccttcccagg

SEQ ID NO: 1937 - DNA, 23 bp, Artificial
  gRNA target site sequence
cgtagacattagcatcaagcagg

SEQ ID NO: 1938 - DNA, 23 bp, Artificial
  gRNA target site sequence
atcaagcaggccccgcgcgttgg

SEQ ID NO: 1939 - DNA, 23 bp, Artificial
  gRNA target site sequence
gcaggccccgcgcgttggcccgg

SEQ ID NO: 1940 - DNA, 23 bp, Artificial
  gRNA target site sequence
gccccgcgcgttggcccggccgg

SEQ ID NO: 1941 - DNA, 23 bp, Artificial
  gRNA target site sequence
cccggccggagagcaccgcctgg

SEQ ID NO: 1942 - DNA, 23 bp, Artificial
  gRNA target site sequence
accgcctggtcactgttaccagg

SEQ ID NO: 1943 - DNA, 23 bp, Artificial
  gRNA target site sequence
gacagacaaccagattttagtgg

SEQ ID NO: 1944 - DNA, 23 bp, Artificial
  gRNA target site sequence
acagacaaccagattttagtggg

SEQ ID NO: 1945 - DNA, 23 bp, Artificial
  gRNA target site sequence
aaccagattttagtgggtgcagg

SEQ ID NO: 1946 - DNA, 23 bp, Artificial
  gRNA target site sequence
tggaggacctgggaaggaggggg

SEQ ID NO: 1947 - DNA, 23 bp, Artificial
  gRNA target site sequence
ctggaggacctgggaaggagggg

SEQ ID NO: 1948 - DNA, 23 bp, Artificial
  gRNA target site sequence
gctggaggacctgggaaggaggg

SEQ ID NO: 1949 - DNA, 23 bp, Artificial
  gRNA target site sequence
ggctggaggacctgggaaggagg

SEQ ID NO: 1950 - DNA, 23 bp, Artificial
  gRNA target site sequence
aagggctggaggacctgggaagg

SEQ ID NO: 1951 - DNA, 23 bp, Artificial
  gRNA target site sequence
gcagaagggctggaggacctggg

SEQ ID NO: 1952 - DNA, 23 bp, Artificial
  gRNA target site sequence
cgcagaagggctggaggacctgg

SEQ ID NO: 1953 - DNA, 23 bp, Artificial
  gRNA target site sequence
gaaagtcgcagaagggctggagg

SEQ ID NO: 1954 - DNA, 23 bp, Artificial
  gRNA target site sequence
ctggaaagtcgcagaagggctgg

SEQ ID NO: 1955 - DNA, 23 bp, Artificial
  gRNA target site sequence
atttctggaaagtcgcagaaggg

SEQ ID NO: 1956 - DNA, 23 bp, Artificial
  gRNA target site sequence
gatttctggaaagtcgcagaagg

SEQ ID NO: 1957 - DNA, 23 bp, Artificial
  gRNA target site sequence
atgctaatgtctacgatttctgg

SEQ ID NO: 1958 - DNA, 23 bp, Artificial
  gRNA target site sequence
tccggccgggccaacgcgcgggg

SEQ ID NO: 1959 - DNA, 23 bp, Artificial
  gRNA target site sequence
ctccggccgggccaacgcgcggg

SEQ ID NO: 1960 - DNA, 23 bp, Artificial
  gRNA target site sequence
tctccggccgggccaacgcgcgg

SEQ ID NO: 1961 - DNA, 23 bp, Artificial
  gRNA target site sequence
ccaggcggtgctctccggccggg

SEQ ID NO: 1962 - DNA, 23 bp, Artificial
  gRNA target site sequence
accaggcggtgctctccggccgg

SEQ ID NO: 1963 - DNA, 23 bp, Artificial
  gRNA target site sequence
agtgaccaggcggtgctctccgg

SEQ ID NO: 1964 - DNA, 23 bp, Artificial
  gRNA target site sequence
tcctggtaacagtgaccaggcgg

SEQ ID NO: 1965 - DNA, 23 bp, Artificial
  gRNA target site sequence
ctgtcctggtaacagtgaccagg

SEQ ID NO: 1966 - DNA, 23 bp, Artificial
  gRNA target site sequence
taaaatctggttgtctgtcctgg

SEQ ID NO: 1967 - DNA, 23 bp, Artificial
  gRNA target site sequence
atcctgcacccactaaaatctgg

SEQ ID NO: 1968 - DNA, 23 bp, Artificial
  gRNA target site sequence
ctccaacccctgcagctacaagg

SEQ ID NO: 1969 - DNA, 23 bp, Artificial
  gRNA target site sequence
aagcctgcgcgacctgatccagg

SEQ ID NO: 1970 - DNA, 23 bp, Artificial
  gRNA target site sequence
agcctgcgcgacctgatccaggg

SEQ ID NO: 1971 - DNA, 23 bp, Artificial
  gRNA target site sequence
agggcctgagcttcgtgacgcgg

SEQ ID NO: 1972 - DNA, 23 bp, Artificial
  gRNA target site sequence
gcctgagcttcgtgacgcggagg

SEQ ID NO: 1973 - DNA, 23 bp, Artificial
  gRNA target site sequence
tcgtgacgcggaggcgtattcgg

SEQ ID NO: 1974 - DNA, 23 bp, Artificial
  gRNA target site sequence
tgacgcggaggcgtattcggagg

SEQ ID NO: 1975 - DNA, 23 bp, Artificial
  gRNA target site sequence
gcggaggcgtattcggaggacgg

SEQ ID NO: 1976 - DNA, 23 bp, Artificial
  gRNA target site sequence
gcgcagagccctgcgccgcgtgg

SEQ ID NO: 1977 - DNA, 23 bp, Artificial
  gRNA target site sequence
gcgccgcgtggccgcctgccagg

SEQ ID NO: 1978 - DNA, 23 bp, Artificial
  gRNA target site sequence
tggccgcctgccaggcagaccgg

SEQ ID NO: 1979 - DNA, 23 bp, Artificial
  gRNA target site sequence
ggcagaccggcactcgctcatgg

SEQ ID NO: 1980 - DNA, 23 bp, Artificial
  gRNA target site sequence
gctcatggccaagtacatcatgg

SEQ ID NO: 1981 - DNA, 23 bp, Artificial
  gRNA target site sequence
ggccaagtacatcatggacctgg

SEQ ID NO: 1982 - DNA, 23 bp, Artificial
  gRNA target site sequence
agtacatcatggacctggagcgg

SEQ ID NO: 1983 - DNA, 23 bp, Artificial
  gRNA target site sequence
catcatggacctggagcggctgg

SEQ ID NO: 1984 - DNA, 23 bp, Artificial
  gRNA target site sequence
ctggagcggctggatccagccgg

SEQ ID NO: 1985 - DNA, 23 bp, Artificial
  gRNA target site sequence
tggagcggctggatccagccggg

SEQ ID NO: 1986 - DNA, 23 bp, Artificial
  gRNA target site sequence
ggagcggctggatccagccgggg

SEQ ID NO: 1987 - DNA, 23 bp, Artificial
  gRNA target site sequence
ggccgccgagaccttccacgtgg

SEQ ID NO: 1988 - DNA, 23 bp, Artificial
  gRNA target site sequence
gccgccgagaccttccacgtggg

SEQ ID NO: 1989 - DNA, 23 bp, Artificial
  gRNA target site sequence
accttccacgtgggcctccctgg

SEQ ID NO: 1990 - DNA, 23 bp, Artificial
  gRNA target site sequence
ccttccacgtgggcctccctggg

SEQ ID NO: 1991 - DNA, 23 bp, Artificial
  gRNA target site sequence
cttccacgtgggcctccctgggg

SEQ ID NO: 1992 - DNA, 23 bp, Artificial
  gRNA target site sequence
gtgggcctccctggggcccttgg

SEQ ID NO: 1993 - DNA, 23 bp, Artificial
  gRNA target site sequence
ggcctccctggggcccttggtgg

SEQ ID NO: 1994 - DNA, 23 bp, Artificial
  gRNA target site sequence
ggggcccttggtggccacgacgg

SEQ ID NO: 1995 - DNA, 23 bp, Artificial
  gRNA target site sequence
gggcccttggtggccacgacggg

SEQ ID NO: 1996 - DNA, 23 bp, Artificial
  gRNA target site sequence
ccttggtggccacgacgggctgg

SEQ ID NO: 1997 - DNA, 23 bp, Artificial
  gRNA target site sequence
cttggtggccacgacgggctggg

SEQ ID NO: 1998 - DNA, 23 bp, Artificial
  gRNA target site sequence
ttggtggccacgacgggctgggg

SEQ ID NO: 1999 - DNA, 23 bp, Artificial
  gRNA target site sequence
cgggctggggctgctccgcgtgg

SEQ ID NO: 2000 - DNA, 23 bp, Artificial
  gRNA target site sequence
ctggggctgctccgcgtggctgg

SEQ ID NO: 2001 - DNA, 23 bp, Artificial
  gRNA target site sequence
ctgctccgcgtggctggtgacgg

SEQ ID NO: 2002 - DNA, 23 bp, Artificial
  gRNA target site sequence
ctccgcgtggctggtgacggcgg

SEQ ID NO: 2003 - DNA, 23 bp, Artificial
  gRNA target site sequence
ctggtgacggcggcatcgcctgg

SEQ ID NO: 2004 - DNA, 23 bp, Artificial
  gRNA target site sequence
cggcggcatcgcctggacccagg

SEQ ID NO: 2005 - DNA, 23 bp, Artificial
  gRNA target site sequence
ggcggcatcgcctggacccaggg

SEQ ID NO: 2006 - DNA, 23 bp, Artificial
  gRNA target site sequence
cgcctggacccagggagaacagg

SEQ ID NO: 2007 - DNA, 23 bp, Artificial
  gRNA target site sequence
ctggacccagggagaacaggagg

SEQ ID NO: 2008 - DNA, 23 bp, Artificial
  gRNA target site sequence
cccagggagaacaggaggtgagg

SEQ ID NO: 2009 - DNA, 23 bp, Artificial
  gRNA target site sequence
ccagggagaacaggaggtgaggg

SEQ ID NO: 2010 - DNA, 23 bp, Artificial
  gRNA target site sequence
gggagaacaggaggtgagggcgg

SEQ ID NO: 2011 - DNA, 23 bp, Artificial
  gRNA target site sequence
gtgagggcggactcccccgctgg

SEQ ID NO: 2012 - DNA, 23 bp, Artificial
  gRNA target site sequence
tgagggcggactcccccgctggg

SEQ ID NO: 2013 - DNA, 23 bp, Artificial
  gRNA target site sequence
gctgcaggggttggaggggaggg

SEQ ID NO: 2014 - DNA, 23 bp, Artificial
  gRNA target site sequence
agctgcaggggttggaggggagg

SEQ ID NO: 2015 - DNA, 23 bp, Artificial
  gRNA target site sequence
tgtagctgcaggggttggagggg

SEQ ID NO: 2016 - DNA, 23 bp, Artificial
  gRNA target site sequence
ttgtagctgcaggggttggaggg

SEQ ID NO: 2017 - DNA, 23 bp, Artificial
  gRNA target site sequence
cttgtagctgcaggggttggagg

SEQ ID NO: 2018 - DNA, 23 bp, Artificial
  gRNA target site sequence
ggccttgtagctgcaggggttgg

SEQ ID NO: 2019 - DNA, 23 bp, Artificial
  gRNA target site sequence
ggcaggccttgtagctgcagggg

SEQ ID NO: 2020 - DNA, 23 bp, Artificial
  gRNA target site sequence
aggcaggccttgtagctgcaggg

SEQ ID NO: 2021 - DNA, 23 bp, Artificial
  gRNA target site sequence
taggcaggccttgtagctgcagg

SEQ ID NO: 2022 - DNA, 23 bp, Artificial
  gRNA target site sequence
gcgcaggcttgggggtaggcagg

SEQ ID NO: 2023 - DNA, 23 bp, Artificial
  gRNA target site sequence
ggtcgcgcaggcttgggggtagg

SEQ ID NO: 2024 - DNA, 23 bp, Artificial
  gRNA target site sequence
atcaggtcgcgcaggcttggggg

SEQ ID NO: 2025 - DNA, 23 bp, Artificial
  gRNA target site sequence
gatcaggtcgcgcaggcttgggg

SEQ ID NO: 2026 - DNA, 23 bp, Artificial
  gRNA target site sequence
ggatcaggtcgcgcaggcttggg

SEQ ID NO: 2027 - DNA, 23 bp, Artificial
  gRNA target site sequence
tggatcaggtcgcgcaggcttgg

SEQ ID NO: 2028 - DNA, 23 bp, Artificial
  gRNA target site sequence
ggccctggatcaggtcgcgcagg

SEQ ID NO: 2029 - DNA, 23 bp, Artificial
  gRNA target site sequence
cgaagctcaggccctggatcagg

SEQ ID NO: 2030 - DNA, 23 bp, Artificial
  gRNA target site sequence
gcgtcacgaagctcaggccctgg

SEQ ID NO: 2031 - DNA, 23 bp, Artificial
  gRNA target site sequence
gcctccgcgtcacgaagctcagg

SEQ ID NO: 2032 - DNA, 23 bp, Artificial
  gRNA target site sequence
gcaggcggccacgcggcgcaggg

SEQ ID NO: 2033 - DNA, 23 bp, Artificial
  gRNA target site sequence
ggcaggcggccacgcggcgcagg

SEQ ID NO: 2034 - DNA, 23 bp, Artificial
  gRNA target site sequence
ctgcctggcaggcggccacgcgg

SEQ ID NO: 2035 - DNA, 23 bp, Artificial
  gRNA target site sequence
gtgccggtctgcctggcaggcgg

SEQ ID NO: 2036 - DNA, 23 bp, Artificial
  gRNA target site sequence
cgagtgccggtctgcctggcagg

SEQ ID NO: 2037 - DNA, 23 bp, Artificial
  gRNA target site sequence
tgagcgagtgccggtctgcctgg

SEQ ID NO: 2038 - DNA, 23 bp, Artificial
  gRNA target site sequence
acttggccatgagcgagtgccgg

SEQ ID NO: 2039 - DNA, 23 bp, Artificial
  gRNA target site sequence
ctccaggtccatgatgtacttgg

SEQ ID NO: 2040 - DNA, 23 bp, Artificial
  gRNA target site sequence
cggctggatccagccgctccagg

SEQ ID NO: 2041 - DNA, 23 bp, Artificial
  gRNA target site sequence
aaggtctcggcggccccggctgg

SEQ ID NO: 2042 - DNA, 23 bp, Artificial
  gRNA target site sequence
gtggaaggtctcggcggccccgg

SEQ ID NO: 2043 - DNA, 23 bp, Artificial
  gRNA target site sequence
gcccacgtggaaggtctcggcgg

SEQ ID NO: 2044 - DNA, 23 bp, Artificial
  gRNA target site sequence
gaggcccacgtggaaggtctcgg

SEQ ID NO: 2045 - DNA, 23 bp, Artificial
  gRNA target site sequence
cccagggaggcccacgtggaagg

SEQ ID NO: 2046 - DNA, 23 bp, Artificial
  gRNA target site sequence
gggccccagggaggcccacgtgg

SEQ ID NO: 2047 - DNA, 23 bp, Artificial
  gRNA target site sequence
ggccaccaagggccccagggagg

SEQ ID NO: 2048 - DNA, 23 bp, Artificial
  gRNA target site sequence
cgtggccaccaagggccccaggg

SEQ ID NO: 2049 - DNA, 23 bp, Artificial
  gRNA target site sequence
tcgtggccaccaagggccccagg

SEQ ID NO: 2050 - DNA, 23 bp, Artificial
  gRNA target site sequence
cagcccgtcgtggccaccaaggg

SEQ ID NO: 2051 - DNA, 23 bp, Artificial
  gRNA target site sequence
ccagcccgtcgtggccaccaagg

SEQ ID NO: 2052 - DNA, 23 bp, Artificial
  gRNA target site sequence
ggagcagccccagcccgtcgtgg

SEQ ID NO: 2053 - DNA, 23 bp, Artificial
  gRNA target site sequence
tgccgccgtcaccagccacgcgg

SEQ ID NO: 2054 - DNA, 23 bp, Artificial
  gRNA target site sequence
ctcctgttctccctgggtccagg

SEQ ID NO: 2055 - DNA, 23 bp, Artificial
  gRNA target site sequence
cctcacctcctgttctccctggg

SEQ ID NO: 2056 - DNA, 23 bp, Artificial
  gRNA target site sequence
ccctcacctcctgttctccctgg

SEQ ID NO: 2057 - DNA, 23 bp, Artificial
  gRNA target site sequence
cccccagcaccgcagtgacctgg

SEQ ID NO: 2058 - DNA, 23 bp, Artificial
  gRNA target site sequence
caccgcagtgacctggtgagtgg

SEQ ID NO: 2059 - DNA, 23 bp, Artificial
  gRNA target site sequence
accgcagtgacctggtgagtggg

SEQ ID NO: 2060 - DNA, 23 bp, Artificial
  gRNA target site sequence
ggtgagtgggcgcctccccgtgg

SEQ ID NO: 2061 - DNA, 23 bp, Artificial
  gRNA target site sequence
gtgagtgggcgcctccccgtggg

SEQ ID NO: 2062 - DNA, 23 bp, Artificial
  gRNA target site sequence
ccccgtgggcctcagtctcaagg

SEQ ID NO: 2063 - DNA, 23 bp, Artificial
  gRNA target site sequence
gggcctcagtctcaaggagcagg

SEQ ID NO: 2064 - DNA, 23 bp, Artificial
  gRNA target site sequence
ggcctcagtctcaaggagcaggg

SEQ ID NO: 2065 - DNA, 23 bp, Artificial
  gRNA target site sequence
gcagggtgagtgtctcagcctgg

SEQ ID NO: 2066 - DNA, 23 bp, Artificial
  gRNA target site sequence
gtgtctcagcctggccgtgttgg

SEQ ID NO: 2067 - DNA, 23 bp, Artificial
  gRNA target site sequence
cagcctggccgtgttggacctgg

SEQ ID NO: 2068 - DNA, 23 bp, Artificial
  gRNA target site sequence
tggccgtgttggacctggcccgg

SEQ ID NO: 2069 - DNA, 23 bp, Artificial
  gRNA target site sequence
cgtgttggacctggcccggatgg

SEQ ID NO: 2070 - DNA, 23 bp, Artificial
  gRNA target site sequence
ggcccggatggcgcgagagcagg

SEQ ID NO: 2071 - DNA, 23 bp, Artificial
  gRNA target site sequence
tggcgcgagagcaggcccagcgg

SEQ ID NO: 2072 - DNA, 23 bp, Artificial
  gRNA target site sequence
gcgagagcaggcccagcggccgg

SEQ ID NO: 2073 - DNA, 23 bp, Artificial
  gRNA target site sequence
cgagagcaggcccagcggccggg

SEQ ID NO: 2074 - DNA, 23 bp, Artificial
  gRNA target site sequence
gagagctgctgaagactgtcagg

SEQ ID NO: 2075 - DNA, 23 bp, Artificial
  gRNA target site sequence
actgtcaggtgagagccaccagg

SEQ ID NO: 2076 - DNA, 23 bp, Artificial
  gRNA target site sequence
aggtgagagccaccaggctgtgg

SEQ ID NO: 2077 - DNA, 23 bp, Artificial
  gRNA target site sequence
ggtgagagccaccaggctgtggg

SEQ ID NO: 2078 - DNA, 23 bp, Artificial
  gRNA target site sequence
gtgagagccaccaggctgtgggg

SEQ ID NO: 2079 - DNA, 23 bp, Artificial
  gRNA target site sequence
ggtgctggggggccgccacaggg

SEQ ID NO: 2080 - DNA, 23 bp, Artificial
  gRNA target site sequence
cggtgctggggggccgccacagg

SEQ ID NO: 2081 - DNA, 23 bp, Artificial
  gRNA target site sequence
caggtcactgcggtgctgggggg

SEQ ID NO: 2082 - DNA, 23 bp, Artificial
  gRNA target site sequence
ccaggtcactgcggtgctggggg

SEQ ID NO: 2083 - DNA, 23 bp, Artificial
  gRNA target site sequence
accaggtcactgcggtgctgggg

SEQ ID NO: 2084 - DNA, 23 bp, Artificial
  gRNA target site sequence
caccaggtcactgcggtgctggg

SEQ ID NO: 2085 - DNA, 23 bp, Artificial
  gRNA target site sequence
tcaccaggtcactgcggtgctgg

SEQ ID NO: 2086 - DNA, 23 bp, Artificial
  gRNA target site sequence
gcccactcaccaggtcactgcgg

SEQ ID NO: 2087 - DNA, 23 bp, Artificial
  gRNA target site sequence
cggggaggcgcccactcaccagg

SEQ ID NO: 2088 - DNA, 23 bp, Artificial
  gRNA target site sequence
tgagactgaggcccacggggagg

SEQ ID NO: 2089 - DNA, 23 bp, Artificial
  gRNA target site sequence
ccttgagactgaggcccacgggg

SEQ ID NO: 2090 - DNA, 23 bp, Artificial
  gRNA target site sequence
tccttgagactgaggcccacggg

SEQ ID NO: 2091 - DNA, 23 bp, Artificial
  gRNA target site sequence
ctccttgagactgaggcccacgg

SEQ ID NO: 2092 - DNA, 23 bp, Artificial
  gRNA target site sequence
caccctgctccttgagactgagg

SEQ ID NO: 2093 - DNA, 23 bp, Artificial
  gRNA target site sequence
gggccaggtccaacacggccagg

SEQ ID NO: 2094 - DNA, 23 bp, Artificial
  gRNA target site sequence
catccgggccaggtccaacacgg

SEQ ID NO: 2095 - DNA, 23 bp, Artificial
  gRNA target site sequence
gctctcgcgccatccgggccagg

SEQ ID NO: 2096 - DNA, 23 bp, Artificial
  gRNA target site sequence
ggcctgctctcgcgccatccggg

SEQ ID NO: 2097 - DNA, 23 bp, Artificial
  gRNA target site sequence
gggcctgctctcgcgccatccgg

SEQ ID NO: 2098 - DNA, 23 bp, Artificial
  gRNA target site sequence
cagcagctctcccggccgctggg

SEQ ID NO: 2099 - DNA, 23 bp, Artificial
  gRNA target site sequence
tcagcagctctcccggccgctgg

SEQ ID NO: 2100 - DNA, 23 bp, Artificial
  gRNA target site sequence
acagtcttcagcagctctcccgg

SEQ ID NO: 2101 - DNA, 23 bp, Artificial
  gRNA target site sequence
acagcttttacttccccaattgg

SEQ ID NO: 2102 - DNA, 23 bp, Artificial
  gRNA target site sequence
ttttacttccccaattggtttgg

SEQ ID NO: 2103 - DNA, 23 bp, Artificial
  gRNA target site sequence
tttacttccccaattggtttggg

SEQ ID NO: 2104 - DNA, 23 bp, Artificial
  gRNA target site sequence
cttccccaattggtttgggctgg

SEQ ID NO: 2105 - DNA, 23 bp, Artificial
  gRNA target site sequence
ctggagaagtgccaccgcttcgg

SEQ ID NO: 2106 - DNA, 23 bp, Artificial
  gRNA target site sequence
tggagaagtgccaccgcttcggg

SEQ ID NO: 2107 - DNA, 23 bp, Artificial
  gRNA target site sequence
ccaccgcttcgggctacgcaagg

SEQ ID NO: 2108 - DNA, 23 bp, Artificial
  gRNA target site sequence
cttcgggctacgcaaggatttgg

SEQ ID NO: 2109 - DNA, 23 bp, Artificial
  gRNA target site sequence
tatccttgacctgccagtcctgg

SEQ ID NO: 2110 - DNA, 23 bp, Artificial
  gRNA target site sequence
cctggagcacctctttgcccagg

SEQ ID NO: 2111 - DNA, 23 bp, Artificial
  gRNA target site sequence
ggagcacctctttgcccaggtgg

SEQ ID NO: 2112 - DNA, 23 bp, Artificial
  gRNA target site sequence
gagcacctctttgcccaggtggg

SEQ ID NO: 2113 - DNA, 23 bp, Artificial
  gRNA target site sequence
agcacctctttgcccaggtgggg

SEQ ID NO: 2114 - DNA, 23 bp, Artificial
  gRNA target site sequence
tgcccaggtggggttctgcctgg

SEQ ID NO: 2115 - DNA, 23 bp, Artificial
  gRNA target site sequence
gcccaggtggggttctgcctggg

SEQ ID NO: 2116 - DNA, 23 bp, Artificial
  gRNA target site sequence
cccaggtggggttctgcctgggg

SEQ ID NO: 2117 - DNA, 23 bp, Artificial
  gRNA target site sequence
gtgaggagaggagagaaccctgg

SEQ ID NO: 2118 - DNA, 23 bp, Artificial
  gRNA target site sequence
gaagtaaaagctgtgaggagagg

SEQ ID NO: 2119 - DNA, 23 bp, Artificial
  gRNA target site sequence
ttggggaagtaaaagctgtgagg

SEQ ID NO: 2120 - DNA, 23 bp, Artificial
  gRNA target site sequence
tctccagcccaaaccaattgggg

SEQ ID NO: 2121 - DNA, 23 bp, Artificial
  gRNA target site sequence
ttctccagcccaaaccaattggg

SEQ ID NO: 2122 - DNA, 23 bp, Artificial
  gRNA target site sequence
cttctccagcccaaaccaattgg

SEQ ID NO: 2123 - DNA, 23 bp, Artificial
  gRNA target site sequence
ccttgcgtagcccgaagcggtgg

SEQ ID NO: 2124 - DNA, 23 bp, Artificial
  gRNA target site sequence
aatccttgcgtagcccgaagcgg

SEQ ID NO: 2125 - DNA, 23 bp, Artificial
  gRNA target site sequence
tggcaggtcaaggatagcactgg

SEQ ID NO: 2126 - DNA, 23 bp, Artificial
  gRNA target site sequence
gctccaggactggcaggtcaagg

SEQ ID NO: 2127 - DNA, 23 bp, Artificial
  gRNA target site sequence
agaggtgctccaggactggcagg

SEQ ID NO: 2128 - DNA, 23 bp, Artificial
  gRNA target site sequence
gcaaagaggtgctccaggactgg

SEQ ID NO: 2129 - DNA, 23 bp, Artificial
  gRNA target site sequence
cctgggcaaagaggtgctccagg

SEQ ID NO: 2130 - DNA, 23 bp, Artificial
  gRNA target site sequence
agaaccccacctgggcaaagagg

SEQ ID NO: 2131 - DNA, 23 bp, Artificial
  gRNA target site sequence
ccccaggcagaaccccacctggg

SEQ ID NO: 2132 - DNA, 23 bp, Artificial
  gRNA target site sequence
accccaggcagaaccccacctgg

SEQ ID NO: 2133 - DNA, 23 bp, Artificial
  gRNA target site sequence
ctgatgggaccatcccctgtagg

SEQ ID NO: 2134 - DNA, 23 bp, Artificial
  gRNA target site sequence
gtaccactccctctttgctctgg

SEQ ID NO: 2135 - DNA, 23 bp, Artificial
  gRNA target site sequence
ctccctctttgctctggccacgg

SEQ ID NO: 2136 - DNA, 23 bp, Artificial
  gRNA target site sequence
cctctttgctctggccacggagg

SEQ ID NO: 2137 - DNA, 23 bp, Artificial
  gRNA target site sequence
ccacggaggacctgtcctgctgg

SEQ ID NO: 2138 - DNA, 23 bp, Artificial
  gRNA target site sequence
cccgagccacatcttctccgtgg

SEQ ID NO: 2139 - DNA, 23 bp, Artificial
  gRNA target site sequence
gagccacatcttctccgtggagg

SEQ ID NO: 2140 - DNA, 23 bp, Artificial
  gRNA target site sequence
gcacccaagtcctgctgtacagg

SEQ ID NO: 2141 - DNA, 23 bp, Artificial
  gRNA target site sequence
aagtcctgctgtacaggattcgg

SEQ ID NO: 2142 - DNA, 23 bp, Artificial
  gRNA target site sequence
cctgctgtacaggattcggtagg

SEQ ID NO: 2143 - DNA, 23 bp, Artificial
  gRNA target site sequence
ggcaggatgcctacaggggatgg

SEQ ID NO: 2144 - DNA, 23 bp, Artificial
  gRNA target site sequence
cacaggcaggatgcctacagggg

SEQ ID NO: 2145 - DNA, 23 bp, Artificial
  gRNA target site sequence
acacaggcaggatgcctacaggg

SEQ ID NO: 2146 - DNA, 23 bp, Artificial
  gRNA target site sequence
tacacaggcaggatgcctacagg

SEQ ID NO: 2147 - DNA, 23 bp, Artificial
  gRNA target site sequence
agagggagtggtacacaggcagg

SEQ ID NO: 2148 - DNA, 23 bp, Artificial
  gRNA target site sequence
gcaaagagggagtggtacacagg

SEQ ID NO: 2149 - DNA, 23 bp, Artificial
  gRNA target site sequence
tggccagagcaaagagggagtgg

SEQ ID NO: 2150 - DNA, 23 bp, Artificial
  gRNA target site sequence
ctccgtggccagagcaaagaggg

SEQ ID NO: 2151 - DNA, 23 bp, Artificial
  gRNA target site sequence
cctccgtggccagagcaaagagg

SEQ ID NO: 2152 - DNA, 23 bp, Artificial
  gRNA target site sequence
ccagcaggacaggtcctccgtgg

SEQ ID NO: 2153 - DNA, 23 bp, Artificial
  gRNA target site sequence
tcggggggaaccagcaggacagg

SEQ ID NO: 2154 - DNA, 23 bp, Artificial
  gRNA target site sequence
gtggctcggggggaaccagcagg

SEQ ID NO: 2155 - DNA, 23 bp, Artificial
  gRNA target site sequence
cggagaagatgtggctcgggggg

SEQ ID NO: 2156 - DNA, 23 bp, Artificial
  gRNA target site sequence
acggagaagatgtggctcggggg

SEQ ID NO: 2157 - DNA, 23 bp, Artificial
  gRNA target site sequence
cacggagaagatgtggctcgggg

SEQ ID NO: 2158 - DNA, 23 bp, Artificial
  gRNA target site sequence
ccacggagaagatgtggctcggg

SEQ ID NO: 2159 - DNA, 23 bp, Artificial
  gRNA target site sequence
tccacggagaagatgtggctcgg

SEQ ID NO: 2160 - DNA, 23 bp, Artificial
  gRNA target site sequence
catcctccacggagaagatgtgg

SEQ ID NO: 2161 - DNA, 23 bp, Artificial
  gRNA target site sequence
ttgggtgctggcatcctccacgg

SEQ ID NO: 2162 - DNA, 23 bp, Artificial
  gRNA target site sequence
gtacagcaggacttgggtgctgg

SEQ ID NO: 2163 - DNA, 23 bp, Artificial
  gRNA target site sequence
aatcctgtacagcaggacttggg

SEQ ID NO: 2164 - DNA, 23 bp, Artificial
  gRNA target site sequence
gaatcctgtacagcaggacttgg

SEQ ID NO: 2165 - DNA, 23 bp, Artificial
  gRNA target site sequence
cctaccgaatcctgtacagcagg

SEQ ID NO: 2166 - DNA, 23 bp, Artificial
  gRNA target site sequence
ccccaggcaagttgcactcatgg

SEQ ID NO: 2167 - DNA, 23 bp, Artificial
  gRNA target site sequence
ttcatgcagcctcttgtccacgg

SEQ ID NO: 2168 - DNA, 23 bp, Artificial
  gRNA target site sequence
atgcagcctcttgtccacggagg

SEQ ID NO: 2169 - DNA, 23 bp, Artificial
  gRNA target site sequence
agcctcttgtccacggaggctgg

SEQ ID NO: 2170 - DNA, 23 bp, Artificial
  gRNA target site sequence
tgcatgtgctgctgcccgctcgg

SEQ ID NO: 2171 - DNA, 23 bp, Artificial
  gRNA target site sequence
gcatgtgctgctgcccgctcggg

SEQ ID NO: 2172 - DNA, 23 bp, Artificial
  gRNA target site sequence
catgtgctgctgcccgctcgggg

SEQ ID NO: 2173 - DNA, 23 bp, Artificial
  gRNA target site sequence
ctgctgcccgctcggggccccgg

SEQ ID NO: 2174 - DNA, 23 bp, Artificial
  gRNA target site sequence
tgctgcccgctcggggccccggg

SEQ ID NO: 2175 - DNA, 23 bp, Artificial
  gRNA target site sequence
cagcgcctatctttctcctttgg

SEQ ID NO: 2176 - DNA, 23 bp, Artificial
  gRNA target site sequence
agcgcctatctttctcctttggg

SEQ ID NO: 2177 - DNA, 23 bp, Artificial
  gRNA target site sequence
gcgcctatctttctcctttgggg

SEQ ID NO: 2178 - DNA, 23 bp, Artificial
  gRNA target site sequence
tttctcctttggggaccacttgg

SEQ ID NO: 2179 - DNA, 23 bp, Artificial
  gRNA target site sequence
ctttggggaccacttggctgagg

SEQ ID NO: 2180 - DNA, 23 bp, Artificial
  gRNA target site sequence
ggctgaggacctgtgcgtgcagg

SEQ ID NO: 2181 - DNA, 23 bp, Artificial
  gRNA target site sequence
cctgtgcgtgcaggctgccaagg

SEQ ID NO: 2182 - DNA, 23 bp, Artificial
  gRNA target site sequence
gtgcaggctgccaaggccagcgg

SEQ ID NO: 2183 - DNA, 23 bp, Artificial
  gRNA target site sequence
agcggtgagtgcatccctagtgg

SEQ ID NO: 2184 - DNA, 23 bp, Artificial
  gRNA target site sequence
tgagtgcatccctagtggatcgg

SEQ ID NO: 2185 - DNA, 23 bp, Artificial
  gRNA target site sequence
gagtgcatccctagtggatcggg

SEQ ID NO: 2186 - DNA, 23 bp, Artificial
  gRNA target site sequence
ccatgagtgcaacttgcctgggg

SEQ ID NO: 2187 - DNA, 23 bp, Artificial
  gRNA target site sequence
gccatgagtgcaacttgcctggg

SEQ ID NO: 2188 - DNA, 23 bp, Artificial
  gRNA target site sequence
tgccatgagtgcaacttgcctgg

SEQ ID NO: 2189 - DNA, 23 bp, Artificial
  gRNA target site sequence
aggggcgtctcttcacttggagg

SEQ ID NO: 2190 - DNA, 23 bp, Artificial
  gRNA target site sequence
atcaggggcgtctcttcacttgg

SEQ ID NO: 2191 - DNA, 23 bp, Artificial
  gRNA target site sequence
catgaacgctgagggatcagggg

SEQ ID NO: 2192 - DNA, 23 bp, Artificial
  gRNA target site sequence
gcatgaacgctgagggatcaggg

SEQ ID NO: 2193 - DNA, 23 bp, Artificial
  gRNA target site sequence
tgcatgaacgctgagggatcagg

SEQ ID NO: 2194 - DNA, 23 bp, Artificial
  gRNA target site sequence
agaggctgcatgaacgctgaggg

SEQ ID NO: 2195 - DNA, 23 bp, Artificial
  gRNA target site sequence
aagaggctgcatgaacgctgagg

SEQ ID NO: 2196 - DNA, 23 bp, Artificial
  gRNA target site sequence
caccagcctccgtggacaagagg

SEQ ID NO: 2197 - DNA, 23 bp, Artificial
  gRNA target site sequence
atgcagggcaccagcctccgtgg

SEQ ID NO: 2198 - DNA, 23 bp, Artificial
  gRNA target site sequence
agcgggcagcagcacatgcaggg

SEQ ID NO: 2199 - DNA, 23 bp, Artificial
  gRNA target site sequence
gagcgggcagcagcacatgcagg

SEQ ID NO: 2200 - DNA, 23 bp, Artificial
  gRNA target site sequence
gggggcccggggccccgagcggg

SEQ ID NO: 2201 - DNA, 23 bp, Artificial
  gRNA target site sequence
ggggggcccggggccccgagcgg

SEQ ID NO: 2202 - DNA, 23 bp, Artificial
  gRNA target site sequence
ataggcgctgggggggcccgggg

SEQ ID NO: 2203 - DNA, 23 bp, Artificial
  gRNA target site sequence
gataggcgctgggggggcccggg

SEQ ID NO: 2204 - DNA, 23 bp, Artificial
  gRNA target site sequence
agataggcgctgggggggcccgg

SEQ ID NO: 2205 - DNA, 23 bp, Artificial
  gRNA target site sequence
gagaaagataggcgctggggggg

SEQ ID NO: 2206 - DNA, 23 bp, Artificial
  gRNA target site sequence
ggagaaagataggcgctgggggg

SEQ ID NO: 2207 - DNA, 23 bp, Artificial
  gRNA target site sequence
aggagaaagataggcgctggggg

SEQ ID NO: 2208 - DNA, 23 bp, Artificial
  gRNA target site sequence
aaggagaaagataggcgctgggg

SEQ ID NO: 2209 - DNA, 23 bp, Artificial
  gRNA target site sequence
aaaggagaaagataggcgctggg

SEQ ID NO: 2210 - DNA, 23 bp, Artificial
  gRNA target site sequence
caaaggagaaagataggcgctgg

SEQ ID NO: 2211 - DNA, 23 bp, Artificial
  gRNA target site sequence
ggtccccaaaggagaaagatagg

SEQ ID NO: 2212 - DNA, 23 bp, Artificial
  gRNA target site sequence
ctcagccaagtggtccccaaagg

SEQ ID NO: 2213 - DNA, 23 bp, Artificial
  gRNA target site sequence
cgcacaggtcctcagccaagtgg

SEQ ID NO: 2214 - DNA, 23 bp, Artificial
  gRNA target site sequence
ccttggcagcctgcacgcacagg

SEQ ID NO: 2215 - DNA, 23 bp, Artificial
  gRNA target site sequence
gatgcactcaccgctggccttgg

SEQ ID NO: 2216 - DNA, 23 bp, Artificial
  gRNA target site sequence
actagggatgcactcaccgctgg

SEQ ID NO: 2217 - DNA, 23 bp, Artificial
  gRNA target site sequence
gaacgaatacagaaaagtaaagg

SEQ ID NO: 2218 - DNA, 23 bp, Artificial
  gRNA target site sequence
cagaaaaaatcagacacttcagg

SEQ ID NO: 2219 - DNA, 23 bp, Artificial
  gRNA target site sequence
agaaaaaatcagacacttcaggg

SEQ ID NO: 2220 - DNA, 23 bp, Artificial
  gRNA target site sequence
tcagggaatttttagattcttgg

SEQ ID NO: 2221 - DNA, 23 bp, Artificial
  gRNA target site sequence
tcagctagaaagagagagaatgg

SEQ ID NO: 2222 - DNA, 23 bp, Artificial
  gRNA target site sequence
gaaagagagagaatggcctatgg

SEQ ID NO: 2223 - DNA, 23 bp, Artificial
  gRNA target site sequence
ttgcttaatttacctagagatgg

SEQ ID NO: 2224 - DNA, 23 bp, Artificial
  gRNA target site sequence
ttaaactacagaacacccactgg

SEQ ID NO: 2225 - DNA, 23 bp, Artificial
  gRNA target site sequence
agaacacccactggaactcatgg

SEQ ID NO: 2226 - DNA, 23 bp, Artificial
  gRNA target site sequence
actggaactcatggagatgctgg

SEQ ID NO: 2227 - DNA, 23 bp, Artificial
  gRNA target site sequence
aagccaagatgtttacagaaagg

SEQ ID NO: 2228 - DNA, 23 bp, Artificial
  gRNA target site sequence
gttcagcacttgagcaaaagtgg

SEQ ID NO: 2229 - DNA, 23 bp, Artificial
  gRNA target site sequence
ttgagcaaaagtggcttatacgg

SEQ ID NO: 2230 - DNA, 23 bp, Artificial
  gRNA target site sequence
gcttatacggatgatcataaagg

SEQ ID NO: 2231 - DNA, 23 bp, Artificial
  gRNA target site sequence
atcataaaggatttaaagcttgg

SEQ ID NO: 2232 - DNA, 23 bp, Artificial
  gRNA target site sequence
gcataatgtcactacagatctgg

SEQ ID NO: 2233 - DNA, 23 bp, Artificial
  gRNA target site sequence
cagatctggaaaaagtctgtagg

SEQ ID NO: 2234 - DNA, 23 bp, Artificial
  gRNA target site sequence
caactgcatgatccttctgtagg

SEQ ID NO: 2235 - DNA, 23 bp, Artificial
  gRNA target site sequence
agatattgagcacattgagaagg

SEQ ID NO: 2236 - DNA, 23 bp, Artificial
  gRNA target site sequence
tacatagaaaccaagctagatgg

SEQ ID NO: 2237 - DNA, 23 bp, Artificial
  gRNA target site sequence
cgtatgcaaatgcacaaagatgg

SEQ ID NO: 2238 - DNA, 23 bp, Artificial
  gRNA target site sequence
tataaatacttctctcgaaatgg

SEQ ID NO: 2239 - DNA, 23 bp, Artificial
  gRNA target site sequence
tataactacactgatcagtttgg

SEQ ID NO: 2240 - DNA, 23 bp, Artificial
  gRNA target site sequence
tttggtgcttctcctactgaagg

SEQ ID NO: 2241 - DNA, 23 bp, Artificial
  gRNA target site sequence
atacaaatctgtattcttgatgg

SEQ ID NO: 2242 - DNA, 23 bp, Artificial
  gRNA target site sequence
tattcttgatggtgagatgatgg

SEQ ID NO: 2243 - DNA, 23 bp, Artificial
  gRNA target site sequence
tacacaaactttcatgcaaaagg

SEQ ID NO: 2244 - DNA, 23 bp, Artificial
  gRNA target site sequence
acacaaactttcatgcaaaaggg

SEQ ID NO: 2245 - DNA, 23 bp, Artificial
  gRNA target site sequence
taagtttgatattaaaagaatgg

SEQ ID NO: 2246 - DNA, 23 bp, Artificial
  gRNA target site sequence
tgatattaaaagaatggtagagg

SEQ ID NO: 2247 - DNA, 23 bp, Artificial
  gRNA target site sequence
ttgtgtttttgatgtattgatgg

SEQ ID NO: 2248 - DNA, 23 bp, Artificial
  gRNA target site sequence
atggttaataataaaaagctagg

SEQ ID NO: 2249 - DNA, 23 bp, Artificial
  gRNA target site sequence
tggttaataataaaaagctaggg

SEQ ID NO: 2250 - DNA, 23 bp, Artificial
  gRNA target site sequence
ggcatgagactctgagaaagagg

SEQ ID NO: 2251 - DNA, 23 bp, Artificial
  gRNA target site sequence
agtatttttacaccaattccagg

SEQ ID NO: 2252 - DNA, 23 bp, Artificial
  gRNA target site sequence
agcaatagataaaagagaagagg

SEQ ID NO: 2253 - DNA, 23 bp, Artificial
  gRNA target site sequence
gcaatagataaaagagaagaggg

SEQ ID NO: 2254 - DNA, 23 bp, Artificial
  gRNA target site sequence
taaaagagaagagggaattatgg

SEQ ID NO: 2255 - DNA, 23 bp, Artificial
  gRNA target site sequence
atctacaagccagacaaaagagg

SEQ ID NO: 2256 - DNA, 23 bp, Artificial
  gRNA target site sequence
aagccagacaaaagaggtgaagg

SEQ ID NO: 2257 - DNA, 23 bp, Artificial
  gRNA target site sequence
agccagacaaaagaggtgaaggg

SEQ ID NO: 2258 - DNA, 23 bp, Artificial
  gRNA target site sequence
cagacaaaagaggtgaagggtgg

SEQ ID NO: 2259 - DNA, 23 bp, Artificial
  gRNA target site sequence
attaaaccagagtatgtcagtgg

SEQ ID NO: 2260 - DNA, 23 bp, Artificial
  gRNA target site sequence
agagtatgtcagtggactaatgg

SEQ ID NO: 2261 - DNA, 23 bp, Artificial
  gRNA target site sequence
cagtggactaatggatgaattgg

SEQ ID NO: 2262 - DNA, 23 bp, Artificial
  gRNA target site sequence
gaattggacattttaattgttgg

SEQ ID NO: 2263 - DNA, 23 bp, Artificial
  gRNA target site sequence
ttggacattttaattgttggagg

SEQ ID NO: 2264 - DNA, 23 bp, Artificial
  gRNA target site sequence
ttttaattgttggaggatattgg

SEQ ID NO: 2265 - DNA, 23 bp, Artificial
  gRNA target site sequence
tttaattgttggaggatattggg

SEQ ID NO: 2266 - DNA, 23 bp, Artificial
  gRNA target site sequence
ttaattgttggaggatattgggg

SEQ ID NO: 2267 - DNA, 23 bp, Artificial
  gRNA target site sequence
gttggaggatattggggtaaagg

SEQ ID NO: 2268 - DNA, 23 bp, Artificial
  gRNA target site sequence
gatattggggtaaaggatcacgg

SEQ ID NO: 2269 - DNA, 23 bp, Artificial
  gRNA target site sequence
atattggggtaaaggatcacggg

SEQ ID NO: 2270 - DNA, 23 bp, Artificial
  gRNA target site sequence
tattggggtaaaggatcacgggg

SEQ ID NO: 2271 - DNA, 23 bp, Artificial
  gRNA target site sequence
tggggtaaaggatcacggggtgg

SEQ ID NO: 2272 - DNA, 23 bp, Artificial
  gRNA target site sequence
gtagcagagaagccccctcctgg

SEQ ID NO: 2273 - DNA, 23 bp, Artificial
  gRNA target site sequence
tttcatactctctctcgtgttgg

SEQ ID NO: 2274 - DNA, 23 bp, Artificial
  gRNA target site sequence
ttcatactctctctcgtgttggg

SEQ ID NO: 2275 - DNA, 23 bp, Artificial
  gRNA target site sequence
actctctctcgtgttgggtctgg

SEQ ID NO: 2276 - DNA, 23 bp, Artificial
  gRNA target site sequence
catgaaagaactgtatgatctgg

SEQ ID NO: 2277 - DNA, 23 bp, Artificial
  gRNA target site sequence
atgaaagaactgtatgatctggg

SEQ ID NO: 2278 - DNA, 23 bp, Artificial
  gRNA target site sequence
gtatgatctgggtttgaaattgg

SEQ ID NO: 2279 - DNA, 23 bp, Artificial
  gRNA target site sequence
gtttgaaattggccaagtattgg

SEQ ID NO: 2280 - DNA, 23 bp, Artificial
  gRNA target site sequence
ccaccaagcagcattttatgtgg

SEQ ID NO: 2281 - DNA, 23 bp, Artificial
  gRNA target site sequence
cccagtgatatgtataaaactgg

SEQ ID NO: 2282 - DNA, 23 bp, Artificial
  gRNA target site sequence
tgaaaagataagagatgacaagg

SEQ ID NO: 2283 - DNA, 23 bp, Artificial
  gRNA target site sequence
agataagagatgacaaggagtgg

SEQ ID NO: 2284 - DNA, 23 bp, Artificial
  gRNA target site sequence
gtggcatgagtgcatgaccctgg

SEQ ID NO: 2285 - DNA, 23 bp, Artificial
  gRNA target site sequence
tggacgacctagaacaacttagg

SEQ ID NO: 2286 - DNA, 23 bp, Artificial
  gRNA target site sequence
ggacgacctagaacaacttaggg

SEQ ID NO: 2287 - DNA, 23 bp, Artificial
  gRNA target site sequence
gacgacctagaacaacttagggg

SEQ ID NO: 2288 - DNA, 23 bp, Artificial
  gRNA target site sequence
acgacctagaacaacttaggggg

SEQ ID NO: 2289 - DNA, 23 bp, Artificial
  gRNA target site sequence
cctagaacaacttagggggaagg

SEQ ID NO: 2290 - DNA, 23 bp, Artificial
  gRNA target site sequence
caacttagggggaaggcatctgg

SEQ ID NO: 2291 - DNA, 23 bp, Artificial
  gRNA target site sequence
gcatctaaacacctttatatagg

SEQ ID NO: 2292 - DNA, 23 bp, Artificial
  gRNA target site sequence
tctaaacacctttatataggtgg

SEQ ID NO: 2293 - DNA, 23 bp, Artificial
  gRNA target site sequence
atgaaccacaagaaaaaaagcgg

SEQ ID NO: 2294 - DNA, 23 bp, Artificial
  gRNA target site sequence
ccaaagatgaagaaagttattgg

SEQ ID NO: 2295 - DNA, 23 bp, Artificial
  gRNA target site sequence
gtagagttttgtgttatgagtgg

SEQ ID NO: 2296 - DNA, 23 bp, Artificial
  gRNA target site sequence
tagccagccaaagcctgacctgg

SEQ ID NO: 2297 - DNA, 23 bp, Artificial
  gRNA target site sequence
gagaacagaattgcagaatttgg

SEQ ID NO: 2298 - DNA, 23 bp, Artificial
  gRNA target site sequence
aacagaattgcagaatttggtgg

SEQ ID NO: 2299 - DNA, 23 bp, Artificial
  gRNA target site sequence
ggttatatagtacaaaatccagg

SEQ ID NO: 2300 - DNA, 23 bp, Artificial
  gRNA target site sequence
gacacgtactgtgtaattgcagg

SEQ ID NO: 2301 - DNA, 23 bp, Artificial
  gRNA target site sequence
acacgtactgtgtaattgcaggg

SEQ ID NO: 2302 - DNA, 23 bp, Artificial
  gRNA target site sequence
atgatgttgtcaagcctgcatgg

SEQ ID NO: 2303 - DNA, 23 bp, Artificial
  gRNA target site sequence
agaccaaaagctttgtaccatgg

SEQ ID NO: 2304 - DNA, 23 bp, Artificial
  gRNA target site sequence
gcccgtgaatatgattgctatgg

SEQ ID NO: 2305 - DNA, 23 bp, Artificial
  gRNA target site sequence
tacagacttgaaccaactgaagg

SEQ ID NO: 2306 - DNA, 23 bp, Artificial
  gRNA target site sequence
caactgaaggaagtattctcagg

SEQ ID NO: 2307 - DNA, 23 bp, Artificial
  gRNA target site sequence
cgagcagactcctgaagaaatgg

SEQ ID NO: 2308 - DNA, 23 bp, Artificial
  gRNA target site sequence
tgattgctgatttagaatatcgg

SEQ ID NO: 2309 - DNA, 23 bp, Artificial
  gRNA target site sequence
atttagaatatcggtattcctgg

SEQ ID NO: 2310 - DNA, 23 bp, Artificial
  gRNA target site sequence
tttagaatatcggtattcctggg

SEQ ID NO: 2311 - DNA, 23 bp, Artificial
  gRNA target site sequence
tcgacgccacaccgtttatttgg

SEQ ID NO: 2312 - DNA, 23 bp, Artificial
  gRNA target site sequence
tgacctgagtaccaaaaatgagg

SEQ ID NO: 2313 - DNA, 23 bp, Artificial
  gRNA target site sequence
gacctgagtaccaaaaatgaggg

SEQ ID NO: 2314 - DNA, 23 bp, Artificial
  gRNA target site sequence
acctgagtaccaaaaatgagggg

SEQ ID NO: 2315 - DNA, 23 bp, Artificial
  gRNA target site sequence
gtaccaaaaatgaggggacaagg

SEQ ID NO: 2316 - DNA, 23 bp, Artificial
  gRNA target site sequence
aaggttagctattaaagccttgg

SEQ ID NO: 2317 - DNA, 23 bp, Artificial
  gRNA target site sequence
ctattaaagccttggagcttcgg

SEQ ID NO: 2318 - DNA, 23 bp, Artificial
  gRNA target site sequence
gccttggagcttcggtttcatgg

SEQ ID NO: 2319 - DNA, 23 bp, Artificial
  gRNA target site sequence
agtagtttcttgtttagctgagg

SEQ ID NO: 2320 - DNA, 23 bp, Artificial
  gRNA target site sequence
gtagtttcttgtttagctgaggg

SEQ ID NO: 2321 - DNA, 23 bp, Artificial
  gRNA target site sequence
ggagtgtctcatgtaataattgg

SEQ ID NO: 2322 - DNA, 23 bp, Artificial
  gRNA target site sequence
gagtgtctcatgtaataattggg

SEQ ID NO: 2323 - DNA, 23 bp, Artificial
  gRNA target site sequence
agtgtctcatgtaataattgggg

SEQ ID NO: 2324 - DNA, 23 bp, Artificial
  gRNA target site sequence
ttaaaatcctaaaagaaagttgg

SEQ ID NO: 2325 - DNA, 23 bp, Artificial
  gRNA target site sequence
taaaatcctaaaagaaagttggg

SEQ ID NO: 2326 - DNA, 23 bp, Artificial
  gRNA target site sequence
aacagtttgtgaagtttgtgagg

SEQ ID NO: 2327 - DNA, 23 bp, Artificial
  gRNA target site sequence
gttgaacacaaatctgcaaaagg

SEQ ID NO: 2328 - DNA, 23 bp, Artificial
  gRNA target site sequence
aagagtctgtgacatctttgtgg

SEQ ID NO: 2329 - DNA, 23 bp, Artificial
  gRNA target site sequence
ggaagaattagtctcattgctgg

SEQ ID NO: 2330 - DNA, 23 bp, Artificial
  gRNA target site sequence
attctctctctttctagctgagg

SEQ ID NO: 2331 - DNA, 23 bp, Artificial
  gRNA target site sequence
catagtttctttaattccatagg

SEQ ID NO: 2332 - DNA, 23 bp, Artificial
  gRNA target site sequence
agggcatcttttccatctctagg

SEQ ID NO: 2333 - DNA, 23 bp, Artificial
  gRNA target site sequence
tctgtagtttaaaagtttgaggg

SEQ ID NO: 2334 - DNA, 23 bp, Artificial
  gRNA target site sequence
ttctgtagtttaaaagtttgagg

SEQ ID NO: 2335 - DNA, 23 bp, Artificial
  gRNA target site sequence
gcatctccatgagttccagtggg

SEQ ID NO: 2336 - DNA, 23 bp, Artificial
  gRNA target site sequence
agcatctccatgagttccagtgg

SEQ ID NO: 2337 - DNA, 23 bp, Artificial
  gRNA target site sequence
cttcctttctgtaaacatcttgg

SEQ ID NO: 2338 - DNA, 23 bp, Artificial
  gRNA target site sequence
aaggtcgtttacttgctgtatgg

SEQ ID NO: 2339 - DNA, 23 bp, Artificial
  gRNA target site sequence
tgctggcaattgagtctaaaagg

SEQ ID NO: 2340 - DNA, 23 bp, Artificial
  gRNA target site sequence
tcttttagcagaattattgctgg

SEQ ID NO: 2341 - DNA, 23 bp, Artificial
  gRNA target site sequence
gaagaaggctcttttttattagg

SEQ ID NO: 2342 - DNA, 23 bp, Artificial
  gRNA target site sequence
tctgagttataagttgaagaagg

SEQ ID NO: 2343 - DNA, 23 bp, Artificial
  gRNA target site sequence
atatcactgagtcctacagaagg

SEQ ID NO: 2344 - DNA, 23 bp, Artificial
  gRNA target site sequence
tctgcaatagcagctagcattgg

SEQ ID NO: 2345 - DNA, 23 bp, Artificial
  gRNA target site sequence
catacgttcaccatctagcttgg

SEQ ID NO: 2346 - DNA, 23 bp, Artificial
  gRNA target site sequence
ggggtaagagaaccttcagtagg

SEQ ID NO: 2347 - DNA, 23 bp, Artificial
  gRNA target site sequence
gaatgcattatgaatgaatgggg

SEQ ID NO: 2348 - DNA, 23 bp, Artificial
  gRNA target site sequence
tgaatgcattatgaatgaatggg

SEQ ID NO: 2349 - DNA, 23 bp, Artificial
  gRNA target site sequence
ttgaatgcattatgaatgaatgg

SEQ ID NO: 2350 - DNA, 23 bp, Artificial
  gRNA target site sequence
agtttgtgtattaggattatagg

SEQ ID NO: 2351 - DNA, 23 bp, Artificial
  gRNA target site sequence
tgcatgaaagtttgtgtattagg

SEQ ID NO: 2352 - DNA, 23 bp, Artificial
  gRNA target site sequence
atttctattctacctggaattgg

SEQ ID NO: 2353 - DNA, 23 bp, Artificial
  gRNA target site sequence
tgcactatttctattctacctgg

SEQ ID NO: 2354 - DNA, 23 bp, Artificial
  gRNA target site sequence
tctggcttgtagatggatagagg

SEQ ID NO: 2355 - DNA, 23 bp, Artificial
  gRNA target site sequence
tcttttgtctggcttgtagatgg

SEQ ID NO: 2356 - DNA, 23 bp, Artificial
  gRNA target site sequence
cacccttcacctcttttgtctgg

SEQ ID NO: 2357 - DNA, 23 bp, Artificial
  gRNA target site sequence
attagtccactgacatactctgg

SEQ ID NO: 2358 - DNA, 23 bp, Artificial
  gRNA target site sequence
gatggcttctcaccaggaggggg

SEQ ID NO: 2359 - DNA, 23 bp, Artificial
  gRNA target site sequence
agatggcttctcaccaggagggg

SEQ ID NO: 2360 - DNA, 23 bp, Artificial
  gRNA target site sequence
cagatggcttctcaccaggaggg

SEQ ID NO: 2361 - DNA, 23 bp, Artificial
  gRNA target site sequence
acagatggcttctcaccaggagg

SEQ ID NO: 2362 - DNA, 23 bp, Artificial
  gRNA target site sequence
aacacagatggcttctcaccagg

SEQ ID NO: 2363 - DNA, 23 bp, Artificial
  gRNA target site sequence
gagagagtatgaaacacagatgg

SEQ ID NO: 2364 - DNA, 23 bp, Artificial
  gRNA target site sequence
cagatcatacagttctttcatgg

SEQ ID NO: 2365 - DNA, 23 bp, Artificial
  gRNA target site sequence
atgaaaaggcttccaatacttgg

SEQ ID NO: 2366 - DNA, 23 bp, Artificial
  gRNA target site sequence
ggtggagcttttctatgaaaagg

SEQ ID NO: 2367 - DNA, 23 bp, Artificial
  gRNA target site sequence
ccacataaaatgctgcttggtgg

SEQ ID NO: 2368 - DNA, 23 bp, Artificial
  gRNA target site sequence
gttccacataaaatgctgcttgg

SEQ ID NO: 2369 - DNA, 23 bp, Artificial
  gRNA target site sequence
caaggttcaatgtatacttctgg

SEQ ID NO: 2370 - DNA, 23 bp, Artificial
  gRNA target site sequence
tgaacaatgacagaattacaagg

SEQ ID NO: 2371 - DNA, 23 bp, Artificial
  gRNA target site sequence
ccagttttatacatatcactggg

SEQ ID NO: 2372 - DNA, 23 bp, Artificial
  gRNA target site sequence
gccagttttatacatatcactgg

SEQ ID NO: 2373 - DNA, 23 bp, Artificial
  gRNA target site sequence
ttcaattcgtggaaaacgcaagg

SEQ ID NO: 2374 - DNA, 23 bp, Artificial
  gRNA target site sequence
tctcttatcttttcaattcgtgg

SEQ ID NO: 2375 - DNA, 23 bp, Artificial
  gRNA target site sequence
aagttgttctaggtcgtccaggg

SEQ ID NO: 2376 - DNA, 23 bp, Artificial
  gRNA target site sequence
taagttgttctaggtcgtccagg

SEQ ID NO: 2377 - DNA, 23 bp, Artificial
  gRNA target site sequence
ccttccccctaagttgttctagg

SEQ ID NO: 2378 - DNA, 23 bp, Artificial
  gRNA target site sequence
catcatcaccacctatataaagg

SEQ ID NO: 2379 - DNA, 23 bp, Artificial
  gRNA target site sequence
gctttccgctttttttcttgtgg

SEQ ID NO: 2380 - DNA, 23 bp, Artificial
  gRNA target site sequence
aataactttcttcatctttgggg

SEQ ID NO: 2381 - DNA, 23 bp, Artificial
  gRNA target site sequence
caataactttcttcatctttggg

SEQ ID NO: 2382 - DNA, 23 bp, Artificial
  gRNA target site sequence
ccaataactttcttcatctttgg

SEQ ID NO: 2383 - DNA, 23 bp, Artificial
  gRNA target site sequence
ttgttaacgttagtaaggttagg

SEQ ID NO: 2384 - DNA, 23 bp, Artificial
  gRNA target site sequence
aaattttgttaacgttagtaagg

SEQ ID NO: 2385 - DNA, 23 bp, Artificial
  gRNA target site sequence
tctccaggtcaggctttggctgg

SEQ ID NO: 2386 - DNA, 23 bp, Artificial
  gRNA target site sequence
ctgttctccaggtcaggctttgg

SEQ ID NO: 2387 - DNA, 23 bp, Artificial
  gRNA target site sequence
gcaattctgttctccaggtcagg

SEQ ID NO: 2388 - DNA, 23 bp, Artificial
  gRNA target site sequence
attctgcaattctgttctccagg

SEQ ID NO: 2389 - DNA, 23 bp, Artificial
  gRNA target site sequence
acacagtacgtgtctgggcctgg

SEQ ID NO: 2390 - DNA, 23 bp, Artificial
  gRNA target site sequence
caattacacagtacgtgtctggg

SEQ ID NO: 2391 - DNA, 23 bp, Artificial
  gRNA target site sequence
gcaattacacagtacgtgtctgg

SEQ ID NO: 2392 - DNA, 23 bp, Artificial
  gRNA target site sequence
aaacattctaaaagccatgcagg

SEQ ID NO: 2393 - DNA, 23 bp, Artificial
  gRNA target site sequence
ctgccatggtacaaagcttttgg

SEQ ID NO: 2394 - DNA, 23 bp, Artificial
  gRNA target site sequence
atcataaagcgaggctgccatgg

SEQ ID NO: 2395 - DNA, 23 bp, Artificial
  gRNA target site sequence
cacatatgaatcataaagcgagg

SEQ ID NO: 2396 - DNA, 23 bp, Artificial
  gRNA target site sequence
caaaatgttctttggttgatggg

SEQ ID NO: 2397 - DNA, 23 bp, Artificial
  gRNA target site sequence
gcaaaatgttctttggttgatgg

SEQ ID NO: 2398 - DNA, 23 bp, Artificial
  gRNA target site sequence
ttcacgggcaaaatgttctttgg

SEQ ID NO: 2399 - DNA, 23 bp, Artificial
  gRNA target site sequence
accatagcaatcatattcacggg

SEQ ID NO: 2400 - DNA, 23 bp, Artificial
  gRNA target site sequence
caccatagcaatcatattcacgg

SEQ ID NO: 2401 - DNA, 23 bp, Artificial
  gRNA target site sequence
ctgagaatacttccttcagttgg

SEQ ID NO: 2402 - DNA, 23 bp, Artificial
  gRNA target site sequence
atcagagaagccatttcttcagg

SEQ ID NO: 2403 - DNA, 23 bp, Artificial
  gRNA target site sequence
actgagaggagagcaatcccagg

SEQ ID NO: 2404 - DNA, 23 bp, Artificial
  gRNA target site sequence
tggcgtcgaaacatactgagagg

SEQ ID NO: 2405 - DNA, 23 bp, Artificial
  gRNA target site sequence
acgagtccaaataaacggtgtgg

SEQ ID NO: 2406 - DNA, 23 bp, Artificial
  gRNA target site sequence
agcatacgagtccaaataaacgg

SEQ ID NO: 2407 - DNA, 23 bp, Artificial
  gRNA target site sequence
tcccctcatttttggtactcagg

SEQ ID NO: 2408 - DNA, 23 bp, Artificial
  gRNA target site sequence
taaccttgtcccctcatttttgg

SEQ ID NO: 2409 - DNA, 23 bp, Artificial
  gRNA target site sequence
tccatgaaaccgaagctccaagg

SEQ ID NO: 2410 - DNA, 23 bp, Artificial
  gRNA target site sequence
cagttacccaactttcttttagg

SEQ ID NO: 2411 - DNA, 23 bp, Artificial
  gRNA target site sequence
acttgggttcccttttttctagg

SEQ ID NO: 2412 - DNA, 23 bp, Artificial
  gRNA target site sequence
cttgggttcccttttttctaggg

SEQ ID NO: 2413 - DNA, 23 bp, Artificial
  gRNA target site sequence
ccttttttctagggtacttcagg

SEQ ID NO: 2414 - DNA, 23 bp, Artificial
  gRNA target site sequence
gcagagacctcagctgtcaaagg

SEQ ID NO: 2415 - DNA, 23 bp, Artificial
  gRNA target site sequence
ctcagctgtcaaaggtcaagagg

SEQ ID NO: 2416 - DNA, 23 bp, Artificial
  gRNA target site sequence
aggtcaagaggaagaagccaagg

SEQ ID NO: 2417 - DNA, 23 bp, Artificial
  gRNA target site sequence
ggtcaagaggaagaagccaaggg

SEQ ID NO: 2418 - DNA, 23 bp, Artificial
  gRNA target site sequence
gtcaagaggaagaagccaagggg

SEQ ID NO: 2419 - DNA, 23 bp, Artificial
  gRNA target site sequence
tctcttcagttaatctgttgtgg

SEQ ID NO: 2420 - DNA, 23 bp, Artificial
  gRNA target site sequence
tgttgtggcctcagctgctgagg

SEQ ID NO: 2421 - DNA, 23 bp, Artificial
  gRNA target site sequence
ctgaagtaccctagaaaaaaggg

SEQ ID NO: 2422 - DNA, 23 bp, Artificial
  gRNA target site sequence
cctgaagtaccctagaaaaaagg

SEQ ID NO: 2423 - DNA, 23 bp, Artificial
  gRNA target site sequence
acagctgaggtctctgcagaggg

SEQ ID NO: 2424 - DNA, 23 bp, Artificial
  gRNA target site sequence
gacagctgaggtctctgcagagg

SEQ ID NO: 2425 - DNA, 23 bp, Artificial
  gRNA target site sequence
ctcttgacctttgacagctgagg

SEQ ID NO: 2426 - DNA, 23 bp, Artificial
  gRNA target site sequence
gattaactgaagagaccccttgg

SEQ ID NO: 2427 - DNA, 23 bp, Artificial
  gRNA target site sequence
ctcttgatctttctgatttcagg

SEQ ID NO: 2428 - DNA, 23 bp, Artificial
  gRNA target site sequence
tcaaacagtgcttccctgcaagg

SEQ ID NO: 2429 - DNA, 23 bp, Artificial
  gRNA target site sequence
tgtaaaccagccagaacaactgg

SEQ ID NO: 2430 - DNA, 23 bp, Artificial
  gRNA target site sequence
agcacctgagaaagagtccacgg

SEQ ID NO: 2431 - DNA, 23 bp, Artificial
  gRNA target site sequence
gtgagtcatgagcagcttcctgg

SEQ ID NO: 2432 - DNA, 23 bp, Artificial
  gRNA target site sequence
gaagcactgtttgaggtatgagg

SEQ ID NO: 2433 - DNA, 23 bp, Artificial
  gRNA target site sequence
ttgcagggaagcactgtttgagg

SEQ ID NO: 2434 - DNA, 23 bp, Artificial
  gRNA target site sequence
ttggctatcgattccttgcaggg

SEQ ID NO: 2435 - DNA, 23 bp, Artificial
  gRNA target site sequence
attggctatcgattccttgcagg

SEQ ID NO: 2436 - DNA, 23 bp, Artificial
  gRNA target site sequence
gttctggctggtttacacattgg

SEQ ID NO: 2437 - DNA, 23 bp, Artificial
  gRNA target site sequence
aggagaccagttgttctggctgg

SEQ ID NO: 2438 - DNA, 23 bp, Artificial
  gRNA target site sequence
gctgaggagaccagttgttctgg

SEQ ID NO: 2439 - DNA, 23 bp, Artificial
  gRNA target site sequence
tgctgagagggttggggctgagg

SEQ ID NO: 2440 - DNA, 23 bp, Artificial
  gRNA target site sequence
ctcaggtgctgagagggttgggg

SEQ ID NO: 2441 - DNA, 23 bp, Artificial
  gRNA target site sequence
tctcaggtgctgagagggttggg

SEQ ID NO: 2442 - DNA, 23 bp, Artificial
  gRNA target site sequence
ttctcaggtgctgagagggttgg

SEQ ID NO: 2443 - DNA, 23 bp, Artificial
  gRNA target site sequence
ctctttctcaggtgctgagaggg

SEQ ID NO: 2444 - DNA, 23 bp, Artificial
  gRNA target site sequence
actctttctcaggtgctgagagg

SEQ ID NO: 2445 - DNA, 23 bp, Artificial
  gRNA target site sequence
ctcaccgtggactctttctcagg

SEQ ID NO: 2446 - DNA, 23 bp, Artificial
  gRNA target site sequence
aagctgctcatgactcaccgtgg

SEQ ID NO: 2447 - DNA, 23 bp, Artificial
  gRNA target site sequence
tctcttacagaaactgccagagg

SEQ ID NO: 2448 - DNA, 23 bp, Artificial
  gRNA target site sequence
ctgccagaggcatgcagcattgg

SEQ ID NO: 2449 - DNA, 23 bp, Artificial
  gRNA target site sequence
gaggcatgcagcattggtgatgg

SEQ ID NO: 2450 - DNA, 23 bp, Artificial
  gRNA target site sequence
gccctttgtcatgaatctgcagg

SEQ ID NO: 2451 - DNA, 23 bp, Artificial
  gRNA target site sequence
gaatctgcaggatctgtatatgg

SEQ ID NO: 2452 - DNA, 23 bp, Artificial
  gRNA target site sequence
tatggcagtcaccacacaagagg

SEQ ID NO: 2453 - DNA, 23 bp, Artificial
  gRNA target site sequence
caccacacaagaggtccaagtgg

SEQ ID NO: 2454 - DNA, 23 bp, Artificial
  gRNA target site sequence
accacacaagaggtccaagtggg

SEQ ID NO: 2455 - DNA, 23 bp, Artificial
  gRNA target site sequence
caagtgggacagaagcatcaagg

SEQ ID NO: 2456 - DNA, 23 bp, Artificial
  gRNA target site sequence
ggacagaagcatcaaggcgctgg

SEQ ID NO: 2457 - DNA, 23 bp, Artificial
  gRNA target site sequence
ggcgctggtgagccctccagagg

SEQ ID NO: 2458 - DNA, 23 bp, Artificial
  gRNA target site sequence
gtgagccctccagaggtacccgg

SEQ ID NO: 2459 - DNA, 23 bp, Artificial
  gRNA target site sequence
tggcagtttctgtaagagagagg

SEQ ID NO: 2460 - DNA, 23 bp, Artificial
  gRNA target site sequence
tcaccaatgctgcatgcctctgg

SEQ ID NO: 2461 - DNA, 23 bp, Artificial
  gRNA target site sequence
tcctgcagattcatgacaaaggg

SEQ ID NO: 2462 - DNA, 23 bp, Artificial
  gRNA target site sequence
atcctgcagattcatgacaaagg

SEQ ID NO: 2463 - DNA, 23 bp, Artificial
  gRNA target site sequence
tcccacttggacctcttgtgtgg

SEQ ID NO: 2464 - DNA, 23 bp, Artificial
  gRNA target site sequence
cttgatgcttctgtcccacttgg

SEQ ID NO: 2465 - DNA, 23 bp, Artificial
  gRNA target site sequence
atttgaagaaaattccttcttgg

SEQ ID NO: 2466 - DNA, 23 bp, Artificial
  gRNA target site sequence
cttggaacaatttatgatagagg

SEQ ID NO: 2467 - DNA, 23 bp, Artificial
  gRNA target site sequence
aacaatttatgatagaggtaagg

SEQ ID NO: 2468 - DNA, 23 bp, Artificial
  gRNA target site sequence
tcaatcgatctgtaataagaagg

SEQ ID NO: 2469 - DNA, 23 bp, Artificial
  gRNA target site sequence
aagaaggaattttcttcaaatgg

SEQ ID NO: 2470 - DNA, 23 bp, Artificial
  gRNA target site sequence
tatcataaattgttccaagaagg

SEQ ID NO: 2471 - DNA, 23 bp, Artificial
  gRNA target site sequence
attgatatctcttccctcaaagg

SEQ ID NO: 2472 - DNA, 23 bp, Artificial
  gRNA target site sequence
acatttgattcgtcctctgatgg

SEQ ID NO: 2473 - DNA, 23 bp, Artificial
  gRNA target site sequence
catttgattcgtcctctgatggg

SEQ ID NO: 2474 - DNA, 23 bp, Artificial
  gRNA target site sequence
tcctctgatgggcatgagtctgg

SEQ ID NO: 2475 - DNA, 23 bp, Artificial
  gRNA target site sequence
tggcattacagtgccaagtgagg

SEQ ID NO: 2476 - DNA, 23 bp, Artificial
  gRNA target site sequence
ggcattacagtgccaagtgaggg

SEQ ID NO: 2477 - DNA, 23 bp, Artificial
  gRNA target site sequence
cctagagatccaagactaccagg

SEQ ID NO: 2478 - DNA, 23 bp, Artificial
  gRNA target site sequence
atccaagactaccaggagagtgg

SEQ ID NO: 2479 - DNA, 23 bp, Artificial
  gRNA target site sequence
tccaagactaccaggagagtggg

SEQ ID NO: 2480 - DNA, 23 bp, Artificial
  gRNA target site sequence
ccaagactaccaggagagtgggg

SEQ ID NO: 2481 - DNA, 23 bp, Artificial
  gRNA target site sequence
agtggggctacgctgattcgagg

SEQ ID NO: 2482 - DNA, 23 bp, Artificial
  gRNA target site sequence
ctacgctgattcgaggtaagagg

SEQ ID NO: 2483 - DNA, 23 bp, Artificial
  gRNA target site sequence
tcgaggtaagaggacattcttgg

SEQ ID NO: 2484 - DNA, 23 bp, Artificial
  gRNA target site sequence
aggtaagaggacattcttggagg

SEQ ID NO: 2485 - DNA, 23 bp, Artificial
  gRNA target site sequence
aaatgttgggagacctttgaggg

SEQ ID NO: 2486 - DNA, 23 bp, Artificial
  gRNA target site sequence
caaatgttgggagacctttgagg

SEQ ID NO: 2487 - DNA, 23 bp, Artificial
  gRNA target site sequence
cagaggacgaatcaaatgttggg

SEQ ID NO: 2488 - DNA, 23 bp, Artificial
  gRNA target site sequence
tcagaggacgaatcaaatgttgg

SEQ ID NO: 2489 - DNA, 23 bp, Artificial
  gRNA target site sequence
gccagactcatgcccatcagagg

SEQ ID NO: 2490 - DNA, 23 bp, Artificial
  gRNA target site sequence
acgttgctagctccctcacttgg

SEQ ID NO: 2491 - DNA, 23 bp, Artificial
  gRNA target site sequence
cctggtagtcttggatctctagg

SEQ ID NO: 2492 - DNA, 23 bp, Artificial
  gRNA target site sequence
ccccactctcctggtagtcttgg

SEQ ID NO: 2493 - DNA, 23 bp, Artificial
  gRNA target site sequence
tcagcgtagccccactctcctgg

SEQ ID NO: 2494 - DNA, 23 bp, Artificial
  gRNA target site sequence
tgtaccactgctctctctttagg

SEQ ID NO: 2495 - DNA, 23 bp, Artificial
  gRNA target site sequence
ctctttaggagctgaacaagcgg

SEQ ID NO: 2496 - DNA, 23 bp, Artificial
  gRNA target site sequence
tgcagctttcctctgtcatttgg

SEQ ID NO: 2497 - DNA, 23 bp, Artificial
  gRNA target site sequence
tctccttcgcccattgttgaagg

SEQ ID NO: 2498 - DNA, 23 bp, Artificial
  gRNA target site sequence
taccttctcctgtgattgtgtgg

SEQ ID NO: 2499 - DNA, 23 bp, Artificial
  gRNA target site sequence
tggcagatgcactgattctacgg

SEQ ID NO: 2500 - DNA, 23 bp, Artificial
  gRNA target site sequence
ggcagatgcactgattctacggg

SEQ ID NO: 2501 - DNA, 23 bp, Artificial
  gRNA target site sequence
cgggtgcgaagtgagctctctgg

SEQ ID NO: 2502 - DNA, 23 bp, Artificial
  gRNA target site sequence
tctctggcctccccttctattgg

SEQ ID NO: 2503 - DNA, 23 bp, Artificial
  gRNA target site sequence
catgctagctagtccttccctgg

SEQ ID NO: 2504 - DNA, 23 bp, Artificial
  gRNA target site sequence
tggtaagtgtaattcgaatgtgg

SEQ ID NO: 2505 - DNA, 23 bp, Artificial
  gRNA target site sequence
ggtaagtgtaattcgaatgtggg

SEQ ID NO: 2506 - DNA, 23 bp, Artificial
  gRNA target site sequence
gtaagtgtaattcgaatgtgggg

SEQ ID NO: 2507 - DNA, 23 bp, Artificial
  gRNA target site sequence
agctcctaaagagagagcagtgg

SEQ ID NO: 2508 - DNA, 23 bp, Artificial
  gRNA target site sequence
tgacagaggaaagctgcaggagg

SEQ ID NO: 2509 - DNA, 23 bp, Artificial
  gRNA target site sequence
aaatgacagaggaaagctgcagg

SEQ ID NO: 2510 - DNA, 23 bp, Artificial
  gRNA target site sequence
ggagattatccaaatgacagagg

SEQ ID NO: 2511 - DNA, 23 bp, Artificial
  gRNA target site sequence
cgtccttcaacaatgggcgaagg

SEQ ID NO: 2512 - DNA, 23 bp, Artificial
  gRNA target site sequence
gagcagcgtccttcaacaatggg

SEQ ID NO: 2513 - DNA, 23 bp, Artificial
  gRNA target site sequence
tgagcagcgtccttcaacaatgg

SEQ ID NO: 2514 - DNA, 23 bp, Artificial
  gRNA target site sequence
aggagaaggtagcttcgctaggg

SEQ ID NO: 2515 - DNA, 23 bp, Artificial
  gRNA target site sequence
caggagaaggtagcttcgctagg

SEQ ID NO: 2516 - DNA, 23 bp, Artificial
  gRNA target site sequence
tgccacacaatcacaggagaagg

SEQ ID NO: 2517 - DNA, 23 bp, Artificial
  gRNA target site sequence
tgcatctgccacacaatcacagg

SEQ ID NO: 2518 - DNA, 23 bp, Artificial
  gRNA target site sequence
ggaaattccaatagaaggggagg

SEQ ID NO: 2519 - DNA, 23 bp, Artificial
  gRNA target site sequence
agtggaaattccaatagaagggg

SEQ ID NO: 2520 - DNA, 23 bp, Artificial
  gRNA target site sequence
cagtggaaattccaatagaaggg

SEQ ID NO: 2521 - DNA, 23 bp, Artificial
  gRNA target site sequence
gcagtggaaattccaatagaagg

SEQ ID NO: 2522 - DNA, 23 bp, Artificial
  gRNA target site sequence
aaggactagctagcatgcagtgg

SEQ ID NO: 2523 - DNA, 23 bp, Artificial
  gRNA target site sequence
cgaattacacttaccagggaagg

SEQ ID NO: 2524 - DNA, 23 bp, Artificial
  gRNA target site sequence
cattcgaattacacttaccaggg

SEQ ID NO: 2525 - DNA, 23 bp, Artificial
  gRNA target site sequence
acattcgaattacacttaccagg

SEQ ID NO: 2526 - DNA, 23 bp, Artificial
  gRNA target site sequence
aatgaggacttttttgcagatgg

SEQ ID NO: 2527 - DNA, 23 bp, Artificial
  gRNA target site sequence
ttttttgcagatggaagaactgg

SEQ ID NO: 2528 - DNA, 23 bp, Artificial
  gRNA target site sequence
cagatggaagaactggagcaagg

SEQ ID NO: 2529 - DNA, 23 bp, Artificial
  gRNA target site sequence
aaggcctgttgatgcagccatgg

SEQ ID NO: 2530 - DNA, 23 bp, Artificial
  gRNA target site sequence
aggcctgttgatgcagccatggg

SEQ ID NO: 2531 - DNA, 23 bp, Artificial
  gRNA target site sequence
tgttgatgcagccatgggcgtgg

SEQ ID NO: 2532 - DNA, 23 bp, Artificial
  gRNA target site sequence
gcttgcagagaactccctcttgg

SEQ ID NO: 2533 - DNA, 23 bp, Artificial
  gRNA target site sequence
agagaactccctcttggccaagg

SEQ ID NO: 2534 - DNA, 23 bp, Artificial
  gRNA target site sequence
caaggtttttatcaccaagcagg

SEQ ID NO: 2535 - DNA, 23 bp, Artificial
  gRNA target site sequence
aaggtttttatcaccaagcaggg

SEQ ID NO: 2536 - DNA, 23 bp, Artificial
  gRNA target site sequence
caagcagggctatgccttgttgg

SEQ ID NO: 2537 - DNA, 23 bp, Artificial
  gRNA target site sequence
gttggtttcagatcttcaacagg

SEQ ID NO: 2538 - DNA, 23 bp, Artificial
  gRNA target site sequence
tttcagatcttcaacaggtgtgg

SEQ ID NO: 2539 - DNA, 23 bp, Artificial
  gRNA target site sequence
tcaacaggtgtggcatgaacagg

SEQ ID NO: 2540 - DNA, 23 bp, Artificial
  gRNA target site sequence
acaggtgtggcatgaacaggtgg

SEQ ID NO: 2541 - DNA, 23 bp, Artificial
  gRNA target site sequence
tgaacaggtggacactagtgtgg

SEQ ID NO: 2542 - DNA, 23 bp, Artificial
  gRNA target site sequence
tgtggtcagccagcgagccaagg

SEQ ID NO: 2543 - DNA, 23 bp, Artificial
  gRNA target site sequence
agcgagccaaggtaagtatgagg

SEQ ID NO: 2544 - DNA, 23 bp, Artificial
  gRNA target site sequence
acgcccatggctgcatcaacagg

SEQ ID NO: 2545 - DNA, 23 bp, Artificial
  gRNA target site sequence
gcaagctgtagccacgcccatgg

SEQ ID NO: 2546 - DNA, 23 bp, Artificial
  gRNA target site sequence
gataaaaaccttggccaagaggg

SEQ ID NO: 2547 - DNA, 23 bp, Artificial
  gRNA target site sequence
tgataaaaaccttggccaagagg

SEQ ID NO: 2548 - DNA, 23 bp, Artificial
  gRNA target site sequence
ctgcttggtgataaaaaccttgg

SEQ ID NO: 2549 - DNA, 23 bp, Artificial
  gRNA target site sequence
caacaaggcatagccctgcttgg

SEQ ID NO: 2550 - DNA, 23 bp, Artificial
  gRNA target site sequence
ttgaagatctgaaaccaacaagg

SEQ ID NO: 2551 - DNA, 23 bp, Artificial
  gRNA target site sequence
tcatacttaccttggctcgctgg

SEQ ID NO: 2552 - DNA, 23 bp, Artificial
  gRNA target site sequence
acttctcctcatacttaccttgg

SEQ ID NO: 2553 - DNA, 23 bp, Artificial
  gRNA target site sequence
agaaggcgtctgcgagaccatgg

SEQ ID NO: 2554 - DNA, 23 bp, Artificial
  gRNA target site sequence
gtctgcgagaccatggagaacgg

SEQ ID NO: 2555 - DNA, 23 bp, Artificial
  gRNA target site sequence
tctgcgagaccatggagaacggg

SEQ ID NO: 2556 - DNA, 23 bp, Artificial
  gRNA target site sequence
gagaccatggagaacgggtgagg

SEQ ID NO: 2557 - DNA, 23 bp, Artificial
  gRNA target site sequence
accatggagaacgggtgaggagg

SEQ ID NO: 2558 - DNA, 23 bp, Artificial
  gRNA target site sequence
ccatggagaacgggtgaggaggg

SEQ ID NO: 2559 - DNA, 23 bp, Artificial
  gRNA target site sequence
gaacgggtgaggagggcaccagg

SEQ ID NO: 2560 - DNA, 23 bp, Artificial
  gRNA target site sequence
gaggagggcaccaggcccgcagg

SEQ ID NO: 2561 - DNA, 23 bp, Artificial
  gRNA target site sequence
ccctcctcacccgttctccatgg

SEQ ID NO: 2562 - DNA, 23 bp, Artificial
  gRNA target site sequence
attataagaacactgcagaatgg

SEQ ID NO: 2563 - DNA, 23 bp, Artificial
  gRNA target site sequence
cctcaagttgcaataatctgtgg

SEQ ID NO: 2564 - DNA, 23 bp, Artificial
  gRNA target site sequence
gttgcaataatctgtggttctgg

SEQ ID NO: 2565 - DNA, 23 bp, Artificial
  gRNA target site sequence
ataatctgtggttctggattagg

SEQ ID NO: 2566 - DNA, 23 bp, Artificial
  gRNA target site sequence
atctgtggttctggattaggagg

SEQ ID NO: 2567 - DNA, 23 bp, Artificial
  gRNA target site sequence
tctgactgataaattaactcagg

SEQ ID NO: 2568 - DNA, 23 bp, Artificial
  gRNA target site sequence
caggcccagatctttgactacgg

SEQ ID NO: 2569 - DNA, 23 bp, Artificial
  gRNA target site sequence
cccaactttccccgaagtacagg

SEQ ID NO: 2570 - DNA, 23 bp, Artificial
  gRNA target site sequence
tttccccgaagtacaggtactgg

SEQ ID NO: 2571 - DNA, 23 bp, Artificial
  gRNA target site sequence
ccgaagtacaggtactggcaagg

SEQ ID NO: 2572 - DNA, 23 bp, Artificial
  gRNA target site sequence
cgaagtacaggtactggcaaggg

SEQ ID NO: 2573 - DNA, 23 bp, Artificial
  gRNA target site sequence
caggtactggcaagggaaagtgg

SEQ ID NO: 2574 - DNA, 23 bp, Artificial
  gRNA target site sequence
aggtactggcaagggaaagtggg

SEQ ID NO: 2575 - DNA, 23 bp, Artificial
  gRNA target site sequence
ggtactggcaagggaaagtgggg

SEQ ID NO: 2576 - DNA, 23 bp, Artificial
  gRNA target site sequence
ctgggggagaaaaaatatcaagg

SEQ ID NO: 2577 - DNA, 23 bp, Artificial
  gRNA target site sequence
atcttcataggtgtatctggggg

SEQ ID NO: 2578 - DNA, 23 bp, Artificial
  gRNA target site sequence
aatcttcataggtgtatctgggg

SEQ ID NO: 2579 - DNA, 23 bp, Artificial
  gRNA target site sequence
taatcttcataggtgtatctggg

SEQ ID NO: 2580 - DNA, 23 bp, Artificial
  gRNA target site sequence
ataatcttcataggtgtatctgg

SEQ ID NO: 2581 - DNA, 23 bp, Artificial
  gRNA target site sequence
agtgttcttataatcttcatagg

SEQ ID NO: 2582 - DNA, 23 bp, Artificial
  gRNA target site sequence
agattattgcaacttgaggtcgg

SEQ ID NO: 2583 - DNA, 23 bp, Artificial
  gRNA target site sequence
ccacagattattgcaacttgagg

SEQ ID NO: 2584 - DNA, 23 bp, Artificial
  gRNA target site sequence
ttcaccgtagtcaaagatctggg

SEQ ID NO: 2585 - DNA, 23 bp, Artificial
  gRNA target site sequence
tttcaccgtagtcaaagatctgg

SEQ ID NO: 2586 - DNA, 23 bp, Artificial
  gRNA target site sequence
ctgtacttcggggaaagttgggg

SEQ ID NO: 2587 - DNA, 23 bp, Artificial
  gRNA target site sequence
cctgtacttcggggaaagttggg

SEQ ID NO: 2588 - DNA, 23 bp, Artificial
  gRNA target site sequence
acctgtacttcggggaaagttgg

SEQ ID NO: 2589 - DNA, 23 bp, Artificial
  gRNA target site sequence
ttgccagtacctgtacttcgggg

SEQ ID NO: 2590 - DNA, 23 bp, Artificial
  gRNA target site sequence
cttgccagtacctgtacttcggg

SEQ ID NO: 2591 - DNA, 23 bp, Artificial
  gRNA target site sequence
ccttgccagtacctgtacttcgg

SEQ ID NO: 2592 - DNA, 23 bp, Artificial
  gRNA target site sequence
tctgttttgtatacagtgccagg

SEQ ID NO: 2593 - DNA, 23 bp, Artificial
  gRNA target site sequence
tatacagtgccaggtcatgctgg

SEQ ID NO: 2594 - DNA, 23 bp, Artificial
  gRNA target site sequence
gccaggtcatgctggccgactgg

SEQ ID NO: 2595 - DNA, 23 bp, Artificial
  gRNA target site sequence
catgctggccgactggtgtttgg

SEQ ID NO: 2596 - DNA, 23 bp, Artificial
  gRNA target site sequence
atgctggccgactggtgtttggg

SEQ ID NO: 2597 - DNA, 23 bp, Artificial
  gRNA target site sequence
ctggtgtttgggttcctgaatgg

SEQ ID NO: 2598 - DNA, 23 bp, Artificial
  gRNA target site sequence
tgtttgggttcctgaatggcagg

SEQ ID NO: 2599 - DNA, 23 bp, Artificial
  gRNA target site sequence
gtttgggttcctgaatggcaggg

SEQ ID NO: 2600 - DNA, 23 bp, Artificial
  gRNA target site sequence
cagggcctgtgtgatgatgcagg

SEQ ID NO: 2601 - DNA, 23 bp, Artificial
  gRNA target site sequence
agggcctgtgtgatgatgcaggg

SEQ ID NO: 2602 - DNA, 23 bp, Artificial
  gRNA target site sequence
cctgtgtgatgatgcagggcagg

SEQ ID NO: 2603 - DNA, 23 bp, Artificial
  gRNA target site sequence
ggcaggttccacatgtatgaagg

SEQ ID NO: 2604 - DNA, 23 bp, Artificial
  gRNA target site sequence
gcaggttccacatgtatgaaggg

SEQ ID NO: 2605 - DNA, 23 bp, Artificial
  gRNA target site sequence
tgtatgaagggtacccactctgg

SEQ ID NO: 2606 - DNA, 23 bp, Artificial
  gRNA target site sequence
tgaagggtacccactctggaagg

SEQ ID NO: 2607 - DNA, 23 bp, Artificial
  gRNA target site sequence
cactctggaaggtaagtcagagg

SEQ ID NO: 2608 - DNA, 23 bp, Artificial
  gRNA target site sequence
actctggaaggtaagtcagaggg

SEQ ID NO: 2609 - DNA, 23 bp, Artificial
  gRNA target site sequence
ggaaggtaagtcagagggatagg

SEQ ID NO: 2610 - DNA, 23 bp, Artificial
  gRNA target site sequence
gtaagtcagagggataggtccgg

SEQ ID NO: 2611 - DNA, 23 bp, Artificial
  gRNA target site sequence
accagtcggccagcatgacctgg

SEQ ID NO: 2612 - DNA, 23 bp, Artificial
  gRNA target site sequence
tcaggaacccaaacaccagtcgg

SEQ ID NO: 2613 - DNA, 23 bp, Artificial
  gRNA target site sequence
tcacacaggccctgccattcagg

SEQ ID NO: 2614 - DNA, 23 bp, Artificial
  gRNA target site sequence
cctgccctgcatcatcacacagg

SEQ ID NO: 2615 - DNA, 23 bp, Artificial
  gRNA target site sequence
gtgggtacccttcatacatgtgg

SEQ ID NO: 2616 - DNA, 23 bp, Artificial
  gRNA target site sequence
tctgacttaccttccagagtggg

SEQ ID NO: 2617 - DNA, 23 bp, Artificial
  gRNA target site sequence
ctctgacttaccttccagagtgg

SEQ ID NO: 2618 - DNA, 23 bp, Artificial
  gRNA target site sequence
tttcggattgtttgcttcgaagg

SEQ ID NO: 2619 - DNA, 23 bp, Artificial
  gRNA target site sequence
cgaaggtgacattcccagtgagg

SEQ ID NO: 2620 - DNA, 23 bp, Artificial
  gRNA target site sequence
gaaggtgacattcccagtgaggg

SEQ ID NO: 2621 - DNA, 23 bp, Artificial
  gRNA target site sequence
agtgagggttttccaccttctgg

SEQ ID NO: 2622 - DNA, 23 bp, Artificial
  gRNA target site sequence
gtgagggttttccaccttctggg

SEQ ID NO: 2623 - DNA, 23 bp, Artificial
  gRNA target site sequence
ggttttccaccttctgggtgtgg

SEQ ID NO: 2624 - DNA, 23 bp, Artificial
  gRNA target site sequence
ccttctgggtgtggacaccctgg

SEQ ID NO: 2625 - DNA, 23 bp, Artificial
  gRNA target site sequence
ctggtagtcaccaatgcagcagg

SEQ ID NO: 2626 - DNA, 23 bp, Artificial
  gRNA target site sequence
gtagtcaccaatgcagcaggagg

SEQ ID NO: 2627 - DNA, 23 bp, Artificial
  gRNA target site sequence
tagtcaccaatgcagcaggaggg

SEQ ID NO: 2628 - DNA, 23 bp, Artificial
  gRNA target site sequence
agggctgaaccccaagtttgagg

SEQ ID NO: 2629 - DNA, 23 bp, Artificial
  gRNA target site sequence
ctgaaccccaagtttgaggttgg

SEQ ID NO: 2630 - DNA, 23 bp, Artificial
  gRNA target site sequence
cgtgaccatatcaacctacctgg

SEQ ID NO: 2631 - DNA, 23 bp, Artificial
  gRNA target site sequence
atcaacctacctggtttcagtgg

SEQ ID NO: 2632 - DNA, 23 bp, Artificial
  gRNA target site sequence
agtggtcagaaccctctcagagg

SEQ ID NO: 2633 - DNA, 23 bp, Artificial
  gRNA target site sequence
gtggtcagaaccctctcagaggg

SEQ ID NO: 2634 - DNA, 23 bp, Artificial
  gRNA target site sequence
tcagagggcccaatgatgaaagg

SEQ ID NO: 2635 - DNA, 23 bp, Artificial
  gRNA target site sequence
gaaggtggaaaaccctcactggg

SEQ ID NO: 2636 - DNA, 23 bp, Artificial
  gRNA target site sequence
agaaggtggaaaaccctcactgg

SEQ ID NO: 2637 - DNA, 23 bp, Artificial
  gRNA target site sequence
gggtgtccacacccagaaggtgg

SEQ ID NO: 2638 - DNA, 23 bp, Artificial
  gRNA target site sequence
ccagggtgtccacacccagaagg

SEQ ID NO: 2639 - DNA, 23 bp, Artificial
  gRNA target site sequence
tgctgcattggtgactaccaggg

SEQ ID NO: 2640 - DNA, 23 bp, Artificial
  gRNA target site sequence
ctgctgcattggtgactaccagg

SEQ ID NO: 2641 - DNA, 23 bp, Artificial
  gRNA target site sequence
gttcagccctcctgctgcattgg

SEQ ID NO: 2642 - DNA, 23 bp, Artificial
  gRNA target site sequence
tatctccaacctcaaacttgggg

SEQ ID NO: 2643 - DNA, 23 bp, Artificial
  gRNA target site sequence
atatctccaacctcaaacttggg

SEQ ID NO: 2644 - DNA, 23 bp, Artificial
  gRNA target site sequence
gatatctccaacctcaaacttgg

SEQ ID NO: 2645 - DNA, 23 bp, Artificial
  gRNA target site sequence
caggtaggttgatatggtcacgg

SEQ ID NO: 2646 - DNA, 23 bp, Artificial
  gRNA target site sequence
tgaaaccaggtaggttgatatgg

SEQ ID NO: 2647 - DNA, 23 bp, Artificial
  gRNA target site sequence
tctgaccactgaaaccaggtagg

SEQ ID NO: 2648 - DNA, 23 bp, Artificial
  gRNA target site sequence
gggttctgaccactgaaaccagg

SEQ ID NO: 2649 - DNA, 23 bp, Artificial
  gRNA target site sequence
catcattgggccctctgagaggg

SEQ ID NO: 2650 - DNA, 23 bp, Artificial
  gRNA target site sequence
tcatcattgggccctctgagagg

SEQ ID NO: 2651 - DNA, 23 bp, Artificial
  gRNA target site sequence
catacatacctttcatcattggg

SEQ ID NO: 2652 - DNA, 23 bp, Artificial
  gRNA target site sequence
acatacatacctttcatcattgg

SEQ ID NO: 2653 - DNA, 23 bp, Artificial
  gRNA target site sequence
gataattcaacctgtgtcctagg

SEQ ID NO: 2654 - DNA, 23 bp, Artificial
  gRNA target site sequence
ttcaacctgtgtcctaggtttgg

SEQ ID NO: 2655 - DNA, 23 bp, Artificial
  gRNA target site sequence
ccatgtctgatgcctacgaccgg

SEQ ID NO: 2656 - DNA, 23 bp, Artificial
  gRNA target site sequence
atgcctacgaccggactatgagg

SEQ ID NO: 2657 - DNA, 23 bp, Artificial
  gRNA target site sequence
acgaccggactatgaggcagagg

SEQ ID NO: 2658 - DNA, 23 bp, Artificial
  gRNA target site sequence
cgaccggactatgaggcagaggg

SEQ ID NO: 2659 - DNA, 23 bp, Artificial
  gRNA target site sequence
ggcagagggctctcagtacctgg

SEQ ID NO: 2660 - DNA, 23 bp, Artificial
  gRNA target site sequence
tctcagtacctggaaacaaatgg

SEQ ID NO: 2661 - DNA, 23 bp, Artificial
  gRNA target site sequence
ctcagtacctggaaacaaatggg

SEQ ID NO: 2662 - DNA, 23 bp, Artificial
  gRNA target site sequence
tcagtacctggaaacaaatgggg

SEQ ID NO: 2663 - DNA, 23 bp, Artificial
  gRNA target site sequence
cagtacctggaaacaaatggggg

SEQ ID NO: 2664 - DNA, 23 bp, Artificial
  gRNA target site sequence
gggggagcaacgtgagctacagg

SEQ ID NO: 2665 - DNA, 23 bp, Artificial
  gRNA target site sequence
gagcaacgtgagctacaggaagg

SEQ ID NO: 2666 - DNA, 23 bp, Artificial
  gRNA target site sequence
acaggaaggcacctatgtgatgg

SEQ ID NO: 2667 - DNA, 23 bp, Artificial
  gRNA target site sequence
ggaaggcacctatgtgatggtgg

SEQ ID NO: 2668 - DNA, 23 bp, Artificial
  gRNA target site sequence
ggcacctatgtgatggtggcagg

SEQ ID NO: 2669 - DNA, 23 bp, Artificial
  gRNA target site sequence
aggccccagctttgagactgtgg

SEQ ID NO: 2670 - DNA, 23 bp, Artificial
  gRNA target site sequence
atgtcgtgtgctgcagaagctgg

SEQ ID NO: 2671 - DNA, 23 bp, Artificial
  gRNA target site sequence
tgtcgtgtgctgcagaagctggg

SEQ ID NO: 2672 - DNA, 23 bp, Artificial
  gRNA target site sequence
aagctgggagcagacgctgttgg

SEQ ID NO: 2673 - DNA, 23 bp, Artificial
  gRNA target site sequence
agcagacgctgttggtgagaagg

SEQ ID NO: 2674 - DNA, 23 bp, Artificial
  gRNA target site sequence
gcagacgctgttggtgagaaggg

SEQ ID NO: 2675 - DNA, 23 bp, Artificial
  gRNA target site sequence
cagacgctgttggtgagaagggg

SEQ ID NO: 2676 - DNA, 23 bp, Artificial
  gRNA target site sequence
tgttggtgagaaggggaatttgg

SEQ ID NO: 2677 - DNA, 23 bp, Artificial
  gRNA target site sequence
ggtgagaaggggaatttggctgg

SEQ ID NO: 2678 - DNA, 23 bp, Artificial
  gRNA target site sequence
gatctccaaacctaggacacagg

SEQ ID NO: 2679 - DNA, 23 bp, Artificial
  gRNA target site sequence
gggaaacgatctccaaacctagg

SEQ ID NO: 2680 - DNA, 23 bp, Artificial
  gRNA target site sequence
cgtaggcatcagacatggcaggg

SEQ ID NO: 2681 - DNA, 23 bp, Artificial
  gRNA target site sequence
tcgtaggcatcagacatggcagg

SEQ ID NO: 2682 - DNA, 23 bp, Artificial
  gRNA target site sequence
ccggtcgtaggcatcagacatgg

SEQ ID NO: 2683 - DNA, 23 bp, Artificial
  gRNA target site sequence
ctgcctcatagtccggtcgtagg

SEQ ID NO: 2684 - DNA, 23 bp, Artificial
  gRNA target site sequence
gagccctctgcctcatagtccgg

SEQ ID NO: 2685 - DNA, 23 bp, Artificial
  gRNA target site sequence
ttgctcccccatttgtttccagg

SEQ ID NO: 2686 - DNA, 23 bp, Artificial
  gRNA target site sequence
ggggcctgccaccatcacatagg

SEQ ID NO: 2687 - DNA, 23 bp, Artificial
  gRNA target site sequence
ctgccacagtctcaaagctgggg

SEQ ID NO: 2688 - DNA, 23 bp, Artificial
  gRNA target site sequence
tctgccacagtctcaaagctggg

SEQ ID NO: 2689 - DNA, 23 bp, Artificial
  gRNA target site sequence
ttctgccacagtctcaaagctgg

SEQ ID NO: 2690 - DNA, 23 bp, Artificial
  gRNA target site sequence
tttccatctttctcactatcagg

SEQ ID NO: 2691 - DNA, 23 bp, Artificial
  gRNA target site sequence
taccagaagttatcgttgcacgg

SEQ ID NO: 2692 - DNA, 23 bp, Artificial
  gRNA target site sequence
gttatcgttgcacggcactgtgg

SEQ ID NO: 2693 - DNA, 23 bp, Artificial
  gRNA target site sequence
cactgtggacttcgagtctttgg

SEQ ID NO: 2694 - DNA, 23 bp, Artificial
  gRNA target site sequence
cttctcactcatcactaacaagg

SEQ ID NO: 2695 - DNA, 23 bp, Artificial
  gRNA target site sequence
catcactaacaaggtcatcatgg

SEQ ID NO: 2696 - DNA, 23 bp, Artificial
  gRNA target site sequence
catcatggattatgaaagcctgg

SEQ ID NO: 2697 - DNA, 23 bp, Artificial
  gRNA target site sequence
ggattatgaaagcctggagaagg

SEQ ID NO: 2698 - DNA, 23 bp, Artificial
  gRNA target site sequence
catgaagaagtcttagcagctgg

SEQ ID NO: 2699 - DNA, 23 bp, Artificial
  gRNA target site sequence
caaacaagctgcacagaaattgg

SEQ ID NO: 2700 - DNA, 23 bp, Artificial
  gRNA target site sequence
acagtttgtctccattcttatgg

SEQ ID NO: 2701 - DNA, 23 bp, Artificial
  gRNA target site sequence
caaagccagttgacctgccttgg

SEQ ID NO: 2702 - DNA, 23 bp, Artificial
  gRNA target site sequence
tgacctgccttggagtcgtctgg

SEQ ID NO: 2703 - DNA, 23 bp, Artificial
  gRNA target site sequence
atgcctgatagtgagaaagatgg

SEQ ID NO: 2704 - DNA, 23 bp, Artificial
  gRNA target site sequence
tgccgtgcaacgataacttctgg

SEQ ID NO: 2705 - DNA, 23 bp, Artificial
  gRNA target site sequence
cttcatggttggccttctccagg

SEQ ID NO: 2706 - DNA, 23 bp, Artificial
  gRNA target site sequence
tgctaagacttcttcatggttgg

SEQ ID NO: 2707 - DNA, 23 bp, Artificial
  gRNA target site sequence
cagctgctaagacttcttcatgg

SEQ ID NO: 2708 - DNA, 23 bp, Artificial
  gRNA target site sequence
tggaatgctggccataagaatgg

SEQ ID NO: 2709 - DNA, 23 bp, Artificial
  gRNA target site sequence
tttgtcagggagtggaatgctgg

SEQ ID NO: 2710 - DNA, 23 bp, Artificial
  gRNA target site sequence
caactggctttgtcagggagtgg

SEQ ID NO: 2711 - DNA, 23 bp, Artificial
  gRNA target site sequence
caggtcaactggctttgtcaggg

SEQ ID NO: 2712 - DNA, 23 bp, Artificial
  gRNA target site sequence
gcaggtcaactggctttgtcagg

SEQ ID NO: 2713 - DNA, 23 bp, Artificial
  gRNA target site sequence
cgactccaaggcaggtcaactgg

SEQ ID NO: 2714 - DNA, 23 bp, Artificial
  gRNA target site sequence
atgccagacgactccaaggcagg

SEQ ID NO: 2715 - DNA, 23 bp, Artificial
  gRNA target site sequence
ttccagtgatgagctactcctgg

SEQ ID NO: 2716 - DNA, 23 bp, Artificial
  gRNA target site sequence
tccagtgatgagctactcctggg

SEQ ID NO: 2717 - DNA, 23 bp, Artificial
  gRNA target site sequence
gctactcctgggtcatgagaagg

SEQ ID NO: 2718 - DNA, 23 bp, Artificial
  gRNA target site sequence
ccctgccttcagagactatgtgg

SEQ ID NO: 2719 - DNA, 23 bp, Artificial
  gRNA target site sequence
cttcagagactatgtggctgtgg

SEQ ID NO: 2720 - DNA, 23 bp, Artificial
  gRNA target site sequence
gactatgtggctgtggcacgagg

SEQ ID NO: 2721 - DNA, 23 bp, Artificial
  gRNA target site sequence
cgtgcccaagaaccagagagtgg

SEQ ID NO: 2722 - DNA, 23 bp, Artificial
  gRNA target site sequence
gtgcccaagaaccagagagtggg

SEQ ID NO: 2723 - DNA, 23 bp, Artificial
  gRNA target site sequence
gactcaagtgaagtgcctgatgg

SEQ ID NO: 2724 - DNA, 23 bp, Artificial
  gRNA target site sequence
agtgaagtgcctgatggaccagg

SEQ ID NO: 2725 - DNA, 23 bp, Artificial
  gRNA target site sequence
gcaacagaccccaacatccttgg

SEQ ID NO: 2726 - DNA, 23 bp, Artificial
  gRNA target site sequence
ccaacatccttggcagaacctgg

SEQ ID NO: 2727 - DNA, 23 bp, Artificial
  gRNA target site sequence
caacatccttggcagaacctggg

SEQ ID NO: 2728 - DNA, 23 bp, Artificial
  gRNA target site sequence
atccttggcagaacctgggaagg

SEQ ID NO: 2729 - DNA, 23 bp, Artificial
  gRNA target site sequence
ttggcagaacctgggaaggatgg

SEQ ID NO: 2730 - DNA, 23 bp, Artificial
  gRNA target site sequence
tggcagaacctgggaaggatggg

SEQ ID NO: 2731 - DNA, 23 bp, Artificial
  gRNA target site sequence
cctgggaaggatgggagccctgg

SEQ ID NO: 2732 - DNA, 23 bp, Artificial
  gRNA target site sequence
ggatgggagccctggatgtgagg

SEQ ID NO: 2733 - DNA, 23 bp, Artificial
  gRNA target site sequence
agccctggatgtgaggtctgtgg

SEQ ID NO: 2734 - DNA, 23 bp, Artificial
  gRNA target site sequence
gccctggatgtgaggtctgtggg

SEQ ID NO: 2735 - DNA, 23 bp, Artificial
  gRNA target site sequence
acccaggagtagctcatcactgg

SEQ ID NO: 2736 - DNA, 23 bp, Artificial
  gRNA target site sequence
caggggccttctcatgacccagg

SEQ ID NO: 2737 - DNA, 23 bp, Artificial
  gRNA target site sequence
cacatagtctctgaaggcagggg

SEQ ID NO: 2738 - DNA, 23 bp, Artificial
  gRNA target site sequence
ccacatagtctctgaaggcaggg

SEQ ID NO: 2739 - DNA, 23 bp, Artificial
  gRNA target site sequence
gccacatagtctctgaaggcagg

SEQ ID NO: 2740 - DNA, 23 bp, Artificial
  gRNA target site sequence
cacagccacatagtctctgaagg

SEQ ID NO: 2741 - DNA, 23 bp, Artificial
  gRNA target site sequence
aagcccactctctggttcttggg

SEQ ID NO: 2742 - DNA, 23 bp, Artificial
  gRNA target site sequence
aaagcccactctctggttcttgg

SEQ ID NO: 2743 - DNA, 23 bp, Artificial
  gRNA target site sequence
tcttctgaaagcccactctctgg

SEQ ID NO: 2744 - DNA, 23 bp, Artificial
  gRNA target site sequence
ggtctgttgcctggtccatcagg

SEQ ID NO: 2745 - DNA, 23 bp, Artificial
  gRNA target site sequence
ggatgttggggtctgttgcctgg

SEQ ID NO: 2746 - DNA, 23 bp, Artificial
  gRNA target site sequence
aggttctgccaaggatgttgggg

SEQ ID NO: 2747 - DNA, 23 bp, Artificial
  gRNA target site sequence
caggttctgccaaggatgttggg

SEQ ID NO: 2748 - DNA, 23 bp, Artificial
  gRNA target site sequence
ccaggttctgccaaggatgttgg

SEQ ID NO: 2749 - DNA, 23 bp, Artificial
  gRNA target site sequence
atccttcccaggttctgccaagg

SEQ ID NO: 2750 - DNA, 23 bp, Artificial
  gRNA target site sequence
ccagggctcccatccttcccagg

SEQ ID NO: 2751 - DNA, 23 bp, Artificial
  gRNA target site sequence
tcccacagacctcacatccaggg

SEQ ID NO: 2752 - DNA, 23 bp, Artificial
  gRNA target site sequence
ctcccacagacctcacatccagg

SEQ ID NO: 2753 - DNA, 23 bp, Artificial
  gRNA target site sequence
gaacagaaaatgctgaaaaaagg

SEQ ID NO: 2754 - DNA, 23 bp, Artificial
  gRNA target site sequence
cagaaaatgctgaaaaaaggagg

SEQ ID NO: 2755 - DNA, 23 bp, Artificial
  gRNA target site sequence
agaaaatgctgaaaaaaggaggg

SEQ ID NO: 2756 - DNA, 23 bp, Artificial
  gRNA target site sequence
tgctgaaaaaaggagggtcatgg

SEQ ID NO: 2757 - DNA, 23 bp, Artificial
  gRNA target site sequence
taaatgttgctgaaaaaaattgg

SEQ ID NO: 2758 - DNA, 23 bp, Artificial
  gRNA target site sequence
tacgctaagagaaagttagcagg

SEQ ID NO: 2759 - DNA, 23 bp, Artificial
  gRNA target site sequence
ccaatccagcagtcattacttgg

SEQ ID NO: 2760 - DNA, 23 bp, Artificial
  gRNA target site sequence
cttggtaagatttttatatgtgg

SEQ ID NO: 2761 - DNA, 23 bp, Artificial
  gRNA target site sequence
cgtaacatattttctgtcggggg

SEQ ID NO: 2762 - DNA, 23 bp, Artificial
  gRNA target site sequence
gcgtaacatattttctgtcgggg

SEQ ID NO: 2763 - DNA, 23 bp, Artificial
  gRNA target site sequence
agcgtaacatattttctgtcggg

SEQ ID NO: 2764 - DNA, 23 bp, Artificial
  gRNA target site sequence
tagcgtaacatattttctgtcgg

SEQ ID NO: 2765 - DNA, 23 bp, Artificial
  gRNA target site sequence
ccaagtaatgactgctggattgg

SEQ ID NO: 2766 - DNA, 23 bp, Artificial
  gRNA target site sequence
tcttaccaagtaatgactgctgg

SEQ ID NO: 2767 - DNA, 23 bp, Artificial
  gRNA target site sequence
tccctgagttgatgccttttcgg

SEQ ID NO: 2768 - DNA, 23 bp, Artificial
  gRNA target site sequence
gatgttaccaatgaaagaaacgg

SEQ ID NO: 2769 - DNA, 23 bp, Artificial
  gRNA target site sequence
atgttaccaatgaaagaaacggg

SEQ ID NO: 2770 - DNA, 23 bp, Artificial
  gRNA target site sequence
gggccttatgtacagcatcatgg

SEQ ID NO: 2771 - DNA, 23 bp, Artificial
  gRNA target site sequence
gcatcatggtacacgcactccgg

SEQ ID NO: 2772 - DNA, 23 bp, Artificial
  gRNA target site sequence
catcatggtacacgcactccggg

SEQ ID NO: 2773 - DNA, 23 bp, Artificial
  gRNA target site sequence
cgggccttccgctcagaccctgg

SEQ ID NO: 2774 - DNA, 23 bp, Artificial
  gRNA target site sequence
tggcctgctcaccaacaccatgg

SEQ ID NO: 2775 - DNA, 23 bp, Artificial
  gRNA target site sequence
caccatggatgtgtttgtcaagg

SEQ ID NO: 2776 - DNA, 23 bp, Artificial
  gRNA target site sequence
tcaaggagccctcctttgattgg

SEQ ID NO: 2777 - DNA, 23 bp, Artificial
  gRNA target site sequence
ccctcctttgattggaaagtagg

SEQ ID NO: 2778 - DNA, 23 bp, Artificial
  gRNA target site sequence
actaaacaagaaaaaaggcaagg

SEQ ID NO: 2779 - DNA, 23 bp, Artificial
  gRNA target site sequence
cagaaactaaacaagaaaaaagg

SEQ ID NO: 2780 - DNA, 23 bp, Artificial
  gRNA target site sequence
aaaggcatcaactcagggactgg

SEQ ID NO: 2781 - DNA, 23 bp, Artificial
  gRNA target site sequence
gccgaaaaggcatcaactcaggg

SEQ ID NO: 2782 - DNA, 23 bp, Artificial
  gRNA target site sequence
agccgaaaaggcatcaactcagg

SEQ ID NO: 2783 - DNA, 23 bp, Artificial
  gRNA target site sequence
aactggcgagttagccgaaaagg

SEQ ID NO: 2784 - DNA, 23 bp, Artificial
  gRNA target site sequence
gtaacatcagattgataaactgg

SEQ ID NO: 2785 - DNA, 23 bp, Artificial
  gRNA target site sequence
ataaggcccgtttctttcattgg

SEQ ID NO: 2786 - DNA, 23 bp, Artificial
  gRNA target site sequence
gtaccatgatgctgtacataagg

SEQ ID NO: 2787 - DNA, 23 bp, Artificial
  gRNA target site sequence
cagggtctgagcggaaggcccgg

SEQ ID NO: 2788 - DNA, 23 bp, Artificial
  gRNA target site sequence
caggccagggtctgagcggaagg

SEQ ID NO: 2789 - DNA, 23 bp, Artificial
  gRNA target site sequence
tgagcaggccagggtctgagcgg

SEQ ID NO: 2790 - DNA, 23 bp, Artificial
  gRNA target site sequence
tggtgttggtgagcaggccaggg

SEQ ID NO: 2791 - DNA, 23 bp, Artificial
  gRNA target site sequence
atggtgttggtgagcaggccagg

SEQ ID NO: 2792 - DNA, 23 bp, Artificial
  gRNA target site sequence
catccatggtgttggtgagcagg

SEQ ID NO: 2793 - DNA, 23 bp, Artificial
  gRNA target site sequence
gacaaacacatccatggtgttgg

SEQ ID NO: 2794 - DNA, 23 bp, Artificial
  gRNA target site sequence
ctccttgacaaacacatccatgg

SEQ ID NO: 2795 - DNA, 23 bp, Artificial
  gRNA target site sequence
cctactttccaatcaaaggaggg

SEQ ID NO: 2796 - DNA, 23 bp, Artificial
  gRNA target site sequence
acctactttccaatcaaaggagg

SEQ ID NO: 2797 - DNA, 23 bp, Artificial
  gRNA target site sequence
aaaacctactttccaatcaaagg

SEQ ID NO: 2798 - DNA, 23 bp, Artificial
  gRNA target site sequence
cacagctgtgtctcttttgtagg

SEQ ID NO: 2799 - DNA, 23 bp, Artificial
  gRNA target site sequence
agctgtgtctcttttgtaggcgg

SEQ ID NO: 2800 - DNA, 23 bp, Artificial
  gRNA target site sequence
gctgtgtctcttttgtaggcggg

SEQ ID NO: 2801 - DNA, 23 bp, Artificial
  gRNA target site sequence
tttgtaggcgggccttcgtgagg

SEQ ID NO: 2802 - DNA, 23 bp, Artificial
  gRNA target site sequence
gaggatgagtacaagccctgagg

SEQ ID NO: 2803 - DNA, 23 bp, Artificial
  gRNA target site sequence
tacaagccctgaggctttcctgg

SEQ ID NO: 2804 - DNA, 23 bp, Artificial
  gRNA target site sequence
ctctgatatgcatcagccactgg

SEQ ID NO: 2805 - DNA, 23 bp, Artificial
  gRNA target site sequence
tgcatcagccactggatcctcgg

SEQ ID NO: 2806 - DNA, 23 bp, Artificial
  gRNA target site sequence
gcatcagccactggatcctcggg

SEQ ID NO: 2807 - DNA, 23 bp, Artificial
  gRNA target site sequence
agccactggatcctcgggattgg

SEQ ID NO: 2808 - DNA, 23 bp, Artificial
  gRNA target site sequence
cagacatctgaacaactttatgg

SEQ ID NO: 2809 - DNA, 23 bp, Artificial
  gRNA target site sequence
acatctgaacaactttatggtgg

SEQ ID NO: 2810 - DNA, 23 bp, Artificial
  gRNA target site sequence
gaacaactttatggtggccatgg

SEQ ID NO: 2811 - DNA, 23 bp, Artificial
  gRNA target site sequence
tttatggtggccatggagactgg

SEQ ID NO: 2812 - DNA, 23 bp, Artificial
  gRNA target site sequence
atggtggccatggagactggcgg

SEQ ID NO: 2813 - DNA, 23 bp, Artificial
  gRNA target site sequence
atggagactggcggcgtgatcgg

SEQ ID NO: 2814 - DNA, 23 bp, Artificial
  gRNA target site sequence
tggagactggcggcgtgatcggg

SEQ ID NO: 2815 - DNA, 23 bp, Artificial
  gRNA target site sequence
ggcgtgatcgggatcgactttgg

SEQ ID NO: 2816 - DNA, 23 bp, Artificial
  gRNA target site sequence
gcgtgatcgggatcgactttggg

SEQ ID NO: 2817 - DNA, 23 bp, Artificial
  gRNA target site sequence
atcgactttgggcatgcgtttgg

SEQ ID NO: 2818 - DNA, 23 bp, Artificial
  gRNA target site sequence
tgcgtttggatccgctacacagg

SEQ ID NO: 2819 - DNA, 23 bp, Artificial
  gRNA target site sequence
acaaaagagacacagctgtgcgg

SEQ ID NO: 2820 - DNA, 23 bp, Artificial
  gRNA target site sequence
gcttgtactcatcctcacgaagg

SEQ ID NO: 2821 - DNA, 23 bp, Artificial
  gRNA target site sequence
ggagcgccaggaaagcctcaggg

SEQ ID NO: 2822 - DNA, 23 bp, Artificial
  gRNA target site sequence
cggagcgccaggaaagcctcagg

SEQ ID NO: 2823 - DNA, 23 bp, Artificial
  gRNA target site sequence
cgaagtgggagcggagcgccagg

SEQ ID NO: 2824 - DNA, 23 bp, Artificial
  gRNA target site sequence
gagagctggcgaagtgggagcgg

SEQ ID NO: 2825 - DNA, 23 bp, Artificial
  gRNA target site sequence
agcgtgagagctggcgaagtggg

SEQ ID NO: 2826 - DNA, 23 bp, Artificial
  gRNA target site sequence
gagcgtgagagctggcgaagtgg

SEQ ID NO: 2827 - DNA, 23 bp, Artificial
  gRNA target site sequence
gcatatcagagcgtgagagctgg

SEQ ID NO: 2828 - DNA, 23 bp, Artificial
  gRNA target site sequence
ctccaatcccgaggatccagtgg

SEQ ID NO: 2829 - DNA, 23 bp, Artificial
  gRNA target site sequence
gatgtctgtctccaatcccgagg

SEQ ID NO: 2830 - DNA, 23 bp, Artificial
  gRNA target site sequence
gatcacgccgccagtctccatgg

SEQ ID NO: 2831 - DNA, 23 bp, Artificial
  gRNA target site sequence
cagcaagtgcacctgtgtagcgg

SEQ ID NO: 2832 - DNA, 23 bp, Artificial
  gRNA target site sequence
tgtttctattattaaatcatagg

SEQ ID NO: 2833 - DNA, 23 bp, Artificial
  gRNA target site sequence
gtttctattattaaatcataggg

SEQ ID NO: 2834 - DNA, 23 bp, Artificial
  gRNA target site sequence
tttctattattaaatcatagggg

SEQ ID NO: 2835 - DNA, 23 bp, Artificial
  gRNA target site sequence
acttactttaagagatcagcagg

SEQ ID NO: 2836 - DNA, 23 bp, Artificial
  gRNA target site sequence
tctcactcattagtgatcccagg

SEQ ID NO: 2837 - DNA, 23 bp, Artificial
  gRNA target site sequence
ctcactcattagtgatcccaggg

SEQ ID NO: 2838 - DNA, 23 bp, Artificial
  gRNA target site sequence
cgccgtgtgaatataaagattgg

SEQ ID NO: 2839 - DNA, 23 bp, Artificial
  gRNA target site sequence
gattggctgacaaaaatgtcagg

SEQ ID NO: 2840 - DNA, 23 bp, Artificial
  gRNA target site sequence
atgtcaggaaaacatgatgttgg

SEQ ID NO: 2841 - DNA, 23 bp, Artificial
  gRNA target site sequence
tgctaatgtataagtaagtttgg

SEQ ID NO: 2842 - DNA, 23 bp, Artificial
  gRNA target site sequence
tcactaatgagtgagaaaagggg

SEQ ID NO: 2843 - DNA, 23 bp, Artificial
  gRNA target site sequence
atcactaatgagtgagaaaaggg

SEQ ID NO: 2844 - DNA, 23 bp, Artificial
  gRNA target site sequence
gatcactaatgagtgagaaaagg

SEQ ID NO: 2845 - DNA, 23 bp, Artificial
  gRNA target site sequence
tattcacacggcggtgccctggg

SEQ ID NO: 2846 - DNA, 23 bp, Artificial
  gRNA target site sequence
atattcacacggcggtgccctgg

SEQ ID NO: 2847 - DNA, 23 bp, Artificial
  gRNA target site sequence
caatctttatattcacacggcgg

SEQ ID NO: 2848 - DNA, 23 bp, Artificial
  gRNA target site sequence
agccaatctttatattcacacgg

SEQ ID NO: 2849 - DNA, 23 bp, Artificial
  gRNA target site sequence
aaccttttattctccctttcagg

SEQ ID NO: 2850 - DNA, 23 bp, Artificial
  gRNA target site sequence
tttattctccctttcaggttagg

SEQ ID NO: 2851 - DNA, 23 bp, Artificial
  gRNA target site sequence
tcaggttaggattaattgagtgg

SEQ ID NO: 2852 - DNA, 23 bp, Artificial
  gRNA target site sequence
tgaaaatactgttaccttgaagg

SEQ ID NO: 2853 - DNA, 23 bp, Artificial
  gRNA target site sequence
tttgaacaccatgtcccaagagg

SEQ ID NO: 2854 - DNA, 23 bp, Artificial
  gRNA target site sequence
caccatgtcccaagaggagaagg

SEQ ID NO: 2855 - DNA, 23 bp, Artificial
  gRNA target site sequence
catgtcccaagaggagaaggcgg

SEQ ID NO: 2856 - DNA, 23 bp, Artificial
  gRNA target site sequence
aggagaaggcggcttacctgagg

SEQ ID NO: 2857 - DNA, 23 bp, Artificial
  gRNA target site sequence
aaggcggcttacctgaggtaagg

SEQ ID NO: 2858 - DNA, 23 bp, Artificial
  gRNA target site sequence
aggcggcttacctgaggtaaggg

SEQ ID NO: 2859 - DNA, 23 bp, Artificial
  gRNA target site sequence
cggcttacctgaggtaagggcgg

SEQ ID NO: 2860 - DNA, 23 bp, Artificial
  gRNA target site sequence
aacctgaaagggagaataaaagg

SEQ ID NO: 2861 - DNA, 23 bp, Artificial
  gRNA target site sequence
caattaatcctaacctgaaaggg

SEQ ID NO: 2862 - DNA, 23 bp, Artificial
  gRNA target site sequence
tcaattaatcctaacctgaaagg

SEQ ID NO: 2863 - DNA, 23 bp, Artificial
  gRNA target site sequence
gttcaaaagaaggtccttcaagg

SEQ ID NO: 2864 - DNA, 23 bp, Artificial
  gRNA target site sequence
gggacatggtgttcaaaagaagg

SEQ ID NO: 2865 - DNA, 23 bp, Artificial
  gRNA target site sequence
cgccttctcctcttgggacatgg

SEQ ID NO: 2866 - DNA, 23 bp, Artificial
  gRNA target site sequence
gtaagccgccttctcctcttggg

SEQ ID NO: 2867 - DNA, 23 bp, Artificial
  gRNA target site sequence
ggtaagccgccttctcctcttgg

SEQ ID NO: 2868 - DNA, 23 bp, Artificial
  gRNA target site sequence
cgtgtggccgcccttacctcagg

SEQ ID NO: 2869 - DNA, 23 bp, Artificial
  gRNA target site sequence
gatgacattctgatttttgaagg

SEQ ID NO: 2870 - DNA, 23 bp, Artificial
  gRNA target site sequence
atttttgaaggtgacagtcatgg

SEQ ID NO: 2871 - DNA, 23 bp, Artificial
  gRNA target site sequence
cagtcatggcgtctctgcgaagg

SEQ ID NO: 2872 - DNA, 23 bp, Artificial
  gRNA target site sequence
cccaagcgcatcatcatccgtgg

SEQ ID NO: 2873 - DNA, 23 bp, Artificial
  gRNA target site sequence
tcatccgtggccatgacgagagg

SEQ ID NO: 2874 - DNA, 23 bp, Artificial
  gRNA target site sequence
catccgtggccatgacgagaggg

SEQ ID NO: 2875 - DNA, 23 bp, Artificial
  gRNA target site sequence
cgagagggaacaccctttcctgg

SEQ ID NO: 2876 - DNA, 23 bp, Artificial
  gRNA target site sequence
ggaacaccctttcctggtgaagg

SEQ ID NO: 2877 - DNA, 23 bp, Artificial
  gRNA target site sequence
gaacaccctttcctggtgaaggg

SEQ ID NO: 2878 - DNA, 23 bp, Artificial
  gRNA target site sequence
caccctttcctggtgaagggtgg

SEQ ID NO: 2879 - DNA, 23 bp, Artificial
  gRNA target site sequence
tttcctggtgaagggtggcgagg

SEQ ID NO: 2880 - DNA, 23 bp, Artificial
  gRNA target site sequence
tgaagggtggcgaggacctgcgg

SEQ ID NO: 2881 - DNA, 23 bp, Artificial
  gRNA target site sequence
gggtggcgaggacctgcggcagg

SEQ ID NO: 2882 - DNA, 23 bp, Artificial
  gRNA target site sequence
cctgcggcaggaccagcgcgtgg

SEQ ID NO: 2883 - DNA, 23 bp, Artificial
  gRNA target site sequence
gcgcgtggagcagctcttccagg

SEQ ID NO: 2884 - DNA, 23 bp, Artificial
  gRNA target site sequence
cagctcttccaggtcatgaatgg

SEQ ID NO: 2885 - DNA, 23 bp, Artificial
  gRNA target site sequence
agctcttccaggtcatgaatggg

SEQ ID NO: 2886 - DNA, 23 bp, Artificial
  gRNA target site sequence
ccaggtcatgaatgggatcctgg

SEQ ID NO: 2887 - DNA, 23 bp, Artificial
  gRNA target site sequence
aagactccgcctgcagccagagg

SEQ ID NO: 2888 - DNA, 23 bp, Artificial
  gRNA target site sequence
agactccgcctgcagccagaggg

SEQ ID NO: 2889 - DNA, 23 bp, Artificial
  gRNA target site sequence
gccagagggccctgcagctgagg

SEQ ID NO: 2890 - DNA, 23 bp, Artificial
  gRNA target site sequence
gcgttgtgcccatgacctccagg

SEQ ID NO: 2891 - DNA, 23 bp, Artificial
  gRNA target site sequence
atgacctccaggtaactgccagg

SEQ ID NO: 2892 - DNA, 23 bp, Artificial
  gRNA target site sequence
ccacggatgatgatgcgcttggg

SEQ ID NO: 2893 - DNA, 23 bp, Artificial
  gRNA target site sequence
gccacggatgatgatgcgcttgg

SEQ ID NO: 2894 - DNA, 23 bp, Artificial
  gRNA target site sequence
gttccctctcgtcatggccacgg

SEQ ID NO: 2895 - DNA, 23 bp, Artificial
  gRNA target site sequence
aagggtgttccctctcgtcatgg

SEQ ID NO: 2896 - DNA, 23 bp, Artificial
  gRNA target site sequence
cgccacccttcaccaggaaaggg

SEQ ID NO: 2897 - DNA, 23 bp, Artificial
  gRNA target site sequence
tcgccacccttcaccaggaaagg

SEQ ID NO: 2898 - DNA, 23 bp, Artificial
  gRNA target site sequence
ggtcctcgccacccttcaccagg

SEQ ID NO: 2899 - DNA, 23 bp, Artificial
  gRNA target site sequence
ccacgcgctggtcctgccgcagg

SEQ ID NO: 2900 - DNA, 23 bp, Artificial
  gRNA target site sequence
ggaagagctgctccacgcgctgg

SEQ ID NO: 2901 - DNA, 23 bp, Artificial
  gRNA target site sequence
ccaggatcccattcatgacctgg

SEQ ID NO: 2902 - DNA, 23 bp, Artificial
  gRNA target site sequence
tgcaggcggagtcttgggccagg

SEQ ID NO: 2903 - DNA, 23 bp, Artificial
  gRNA target site sequence
ctggctgcaggcggagtcttggg

SEQ ID NO: 2904 - DNA, 23 bp, Artificial
  gRNA target site sequence
tctggctgcaggcggagtcttgg

SEQ ID NO: 2905 - DNA, 23 bp, Artificial
  gRNA target site sequence
cagggccctctggctgcaggcgg

SEQ ID NO: 2906 - DNA, 23 bp, Artificial
  gRNA target site sequence
ctgcagggccctctggctgcagg

SEQ ID NO: 2907 - DNA, 23 bp, Artificial
  gRNA target site sequence
tcctcagctgcagggccctctgg

SEQ ID NO: 2908 - DNA, 23 bp, Artificial
  gRNA target site sequence
gctataggtcctcagctgcaggg

SEQ ID NO: 2909 - DNA, 23 bp, Artificial
  gRNA target site sequence
cgctataggtcctcagctgcagg

SEQ ID NO: 2910 - DNA, 23 bp, Artificial
  gRNA target site sequence
ggtcatgggcacaacgctatagg

SEQ ID NO: 2911 - DNA, 23 bp, Artificial
  gRNA target site sequence
ggcagttacctggaggtcatggg

SEQ ID NO: 2912 - DNA, 23 bp, Artificial
  gRNA target site sequence
tggcagttacctggaggtcatgg

SEQ ID NO: 2913 - DNA, 23 bp, Artificial
  gRNA target site sequence
gcagcctggcagttacctggagg

SEQ ID NO: 2914 - DNA, 23 bp, Artificial
  gRNA target site sequence
ggagcagcctggcagttacctgg

SEQ ID NO: 2915 - DNA, 23 bp, Artificial
  gRNA target site sequence
gcaaggttctggtttgttttagg

SEQ ID NO: 2916 - DNA, 23 bp, Artificial
  gRNA target site sequence
tttgttttaggtcagtatgacgg

SEQ ID NO: 2917 - DNA, 23 bp, Artificial
  gRNA target site sequence
ttttaggtcagtatgacggtagg

SEQ ID NO: 2918 - DNA, 23 bp, Artificial
  gRNA target site sequence
tttaggtcagtatgacggtaggg

SEQ ID NO: 2919 - DNA, 23 bp, Artificial
  gRNA target site sequence
ttaggtcagtatgacggtagggg

SEQ ID NO: 2920 - DNA, 23 bp, Artificial
  gRNA target site sequence
gagtaccacgtgcgaatcgccgg

SEQ ID NO: 2921 - DNA, 23 bp, Artificial
  gRNA target site sequence
agtaccacgtgcgaatcgccggg

SEQ ID NO: 2922 - DNA, 23 bp, Artificial
  gRNA target site sequence
gaatcgccgggtttgatgagcgg

SEQ ID NO: 2923 - DNA, 23 bp, Artificial
  gRNA target site sequence
aatcgccgggtttgatgagcggg

SEQ ID NO: 2924 - DNA, 23 bp, Artificial
  gRNA target site sequence
gccgggtttgatgagcgggtagg

SEQ ID NO: 2925 - DNA, 23 bp, Artificial
  gRNA target site sequence
ttgatgagcgggtaggtgtgagg

SEQ ID NO: 2926 - DNA, 23 bp, Artificial
  gRNA target site sequence
tgatgagcgggtaggtgtgaggg

SEQ ID NO: 2927 - DNA, 23 bp, Artificial
  gRNA target site sequence
cgcacgtggtactctggcaatgg

SEQ ID NO: 2928 - DNA, 23 bp, Artificial
  gRNA target site sequence
gcgattcgcacgtggtactctgg

SEQ ID NO: 2929 - DNA, 23 bp, Artificial
  gRNA target site sequence
caaacccggcgattcgcacgtgg

SEQ ID NO: 2930 - DNA, 23 bp, Artificial
  gRNA target site sequence
acctacccgctcatcaaacccgg

SEQ ID NO: 2931 - DNA, 23 bp, Artificial
  gRNA target site sequence
tcttactaatttcagacttttgg

SEQ ID NO: 2932 - DNA, 23 bp, Artificial
  gRNA target site sequence
aaagaatttgataaacattttgg

SEQ ID NO: 2933 - DNA, 23 bp, Artificial
  gRNA target site sequence
aagaatttgataaacattttggg

SEQ ID NO: 2934 - DNA, 23 bp, Artificial
  gRNA target site sequence
tttgataaacattttgggaaagg

SEQ ID NO: 2935 - DNA, 23 bp, Artificial
  gRNA target site sequence
gataaacattttgggaaaggagg

SEQ ID NO: 2936 - DNA, 23 bp, Artificial
  gRNA target site sequence
aacaaagactcaaagccccctgg

SEQ ID NO: 2937 - DNA, 23 bp, Artificial
  gRNA target site sequence
acaaagactcaaagccccctggg

SEQ ID NO: 2938 - DNA, 23 bp, Artificial
  gRNA target site sequence
atctgaaagaatgttcaccctgg

SEQ ID NO: 2939 - DNA, 23 bp, Artificial
  gRNA target site sequence
ctggatgagcgacttcaaagtgg

SEQ ID NO: 2940 - DNA, 23 bp, Artificial
  gRNA target site sequence
ggagttcctgagaaatgagctgg

SEQ ID NO: 2941 - DNA, 23 bp, Artificial
  gRNA target site sequence
agaaatgagctggagattcccgg

SEQ ID NO: 2942 - DNA, 23 bp, Artificial
  gRNA target site sequence
ttcccggtgagttaacctccagg

SEQ ID NO: 2943 - DNA, 23 bp, Artificial
  gRNA target site sequence
tcccggtgagttaacctccaggg

SEQ ID NO: 2944 - DNA, 23 bp, Artificial
  gRNA target site sequence
cccggtgagttaacctccagggg

SEQ ID NO: 2945 - DNA, 23 bp, Artificial
  gRNA target site sequence
catttttaaaagtagcatgttgg

SEQ ID NO: 2946 - DNA, 23 bp, Artificial
  gRNA target site sequence
cattctttcagattcccaggggg

SEQ ID NO: 2947 - DNA, 23 bp, Artificial
  gRNA target site sequence
acattctttcagattcccagggg

SEQ ID NO: 2948 - DNA, 23 bp, Artificial
  gRNA target site sequence
aacattctttcagattcccaggg

SEQ ID NO: 2949 - DNA, 23 bp, Artificial
  gRNA target site sequence
gaacattctttcagattcccagg

SEQ ID NO: 2950 - DNA, 23 bp, Artificial
  gRNA target site sequence
actttgaagtcgctcatccaggg

SEQ ID NO: 2951 - DNA, 23 bp, Artificial
  gRNA target site sequence
cactttgaagtcgctcatccagg

SEQ ID NO: 2952 - DNA, 23 bp, Artificial
  gRNA target site sequence
gaatctccagctcatttctcagg

SEQ ID NO: 2953 - DNA, 23 bp, Artificial
  gRNA target site sequence
cccctggaggttaactcaccggg

SEQ ID NO: 2954 - DNA, 23 bp, Artificial
  gRNA target site sequence
acccctggaggttaactcaccgg

SEQ ID NO: 2955 - DNA, 23 bp, Artificial
  gRNA target site sequence
tactttttttttcccctgacagg

SEQ ID NO: 2956 - DNA, 23 bp, Artificial
  gRNA target site sequence
tttttttcccctgacaggattgg

SEQ ID NO: 2957 - DNA, 23 bp, Artificial
  gRNA target site sequence
tgaaagaatgtatgcagccttgg

SEQ ID NO: 2958 - DNA, 23 bp, Artificial
  gRNA target site sequence
gaaagaatgtatgcagccttggg

SEQ ID NO: 2959 - DNA, 23 bp, Artificial
  gRNA target site sequence
tgcagccttgggtgacccaaagg

SEQ ID NO: 2960 - DNA, 23 bp, Artificial
  gRNA target site sequence
ttgggtgacccaaaggctccagg

SEQ ID NO: 2961 - DNA, 23 bp, Artificial
  gRNA target site sequence
tgacccaaaggctccaggcctgg

SEQ ID NO: 2962 - DNA, 23 bp, Artificial
  gRNA target site sequence
gacccaaaggctccaggcctggg

SEQ ID NO: 2963 - DNA, 23 bp, Artificial
  gRNA target site sequence
acccaaaggctccaggcctgggg

SEQ ID NO: 2964 - DNA, 23 bp, Artificial
  gRNA target site sequence
cccaaaggctccaggcctggggg

SEQ ID NO: 2965 - DNA, 23 bp, Artificial
  gRNA target site sequence
caggcctgggggcctttagaagg

SEQ ID NO: 2966 - DNA, 23 bp, Artificial
  gRNA target site sequence
ctttagaaggaagtttattcagg

SEQ ID NO: 2967 - DNA, 23 bp, Artificial
  gRNA target site sequence
gaaggaagtttattcaggtatgg

SEQ ID NO: 2968 - DNA, 23 bp, Artificial
  gRNA target site sequence
aagtttattcaggtatggactgg

SEQ ID NO: 2969 - DNA, 23 bp, Artificial
  gRNA target site sequence
cattgctccaatcctgtcagggg

SEQ ID NO: 2970 - DNA, 23 bp, Artificial
  gRNA target site sequence
tcattgctccaatcctgtcaggg

SEQ ID NO: 2971 - DNA, 23 bp, Artificial
  gRNA target site sequence
atcattgctccaatcctgtcagg

SEQ ID NO: 2972 - DNA, 23 bp, Artificial
  gRNA target site sequence
aatgttttttttatttacagggg

SEQ ID NO: 2973 - DNA, 23 bp, Artificial
  gRNA target site sequence
caatgttttttttatttacaggg

SEQ ID NO: 2974 - DNA, 23 bp, Artificial
  gRNA target site sequence
tcaatgttttttttatttacagg

SEQ ID NO: 2975 - DNA, 23 bp, Artificial
  gRNA target site sequence
tggagcctttgggtcacccaagg

SEQ ID NO: 2976 - DNA, 23 bp, Artificial
  gRNA target site sequence
cccccaggcctggagcctttggg

SEQ ID NO: 2977 - DNA, 23 bp, Artificial
  gRNA target site sequence
gcccccaggcctggagcctttgg

SEQ ID NO: 2978 - DNA, 23 bp, Artificial
  gRNA target site sequence
cttctaaaggcccccaggcctgg

SEQ ID NO: 2979 - DNA, 23 bp, Artificial
  gRNA target site sequence
acttccttctaaaggcccccagg

SEQ ID NO: 2980 - DNA, 23 bp, Artificial
  gRNA target site sequence
ctgaataaacttccttctaaagg

SEQ ID NO: 2981 - DNA, 23 bp, Artificial
  gRNA target site sequence
ctttgtaaatttttttaaatagg

SEQ ID NO: 2982 - DNA, 23 bp, Artificial
  gRNA target site sequence
aaataggattaaaagtaagttgg

SEQ ID NO: 2983 - DNA, 23 bp, Artificial
  gRNA target site sequence
attaaaagtaagttggatcaagg

SEQ ID NO: 2984 - DNA, 23 bp, Artificial
  gRNA target site sequence
aaaagtaagttggatcaaggagg

SEQ ID NO: 2985 - DNA, 23 bp, Artificial
  gRNA target site sequence
taatcctgaactgctctttaagg

SEQ ID NO: 2986 - DNA, 23 bp, Artificial
  gRNA target site sequence
tctttaaggtaatgatagaacgg

SEQ ID NO: 2987 - DNA, 23 bp, Artificial
  gRNA target site sequence
ggtaatgatagaacggcttctgg

SEQ ID NO: 2988 - DNA, 23 bp, Artificial
  gRNA target site sequence
aggattagagagctgatctaagg

SEQ ID NO: 2989 - DNA, 23 bp, Artificial
  gRNA target site sequence
attaccttaaagagcagttcagg

SEQ ID NO: 2990 - DNA, 23 bp, Artificial
  gRNA target site sequence
agatctcttccgttccctgctgg

SEQ ID NO: 2991 - DNA, 23 bp, Artificial
  gRNA target site sequence
cctgctggcagttcatcagctgg

SEQ ID NO: 2992 - DNA, 23 bp, Artificial
  gRNA target site sequence
catcagctggatcagccacatgg

SEQ ID NO: 2993 - DNA, 23 bp, Artificial
  gRNA target site sequence
cagctggatcagccacatggtgg

SEQ ID NO: 2994 - DNA, 23 bp, Artificial
  gRNA target site sequence
cagccacatggtggccttactgg

SEQ ID NO: 2995 - DNA, 23 bp, Artificial
  gRNA target site sequence
cgttgctgttcagcactctgtgg

SEQ ID NO: 2996 - DNA, 23 bp, Artificial
  gRNA target site sequence
aatcactgataactacccgcagg

SEQ ID NO: 2997 - DNA, 23 bp, Artificial
  gRNA target site sequence
cagcgaaagctattccttcaagg

SEQ ID NO: 2998 - DNA, 23 bp, Artificial
  gRNA target site sequence
tccttcaaggatacttctactgg

SEQ ID NO: 2999 - DNA, 23 bp, Artificial
  gRNA target site sequence
ttctactggtcataagaataagg

SEQ ID NO: 3000 - DNA, 23 bp, Artificial
  gRNA target site sequence
tcataagaataaggagtttgtgg

SEQ ID NO: 3001 - DNA, 23 bp, Artificial
  gRNA target site sequence
agaataaggagtttgtggcaagg

SEQ ID NO: 3002 - DNA, 23 bp, Artificial
  gRNA target site sequence
taaggagtttgtggcaaggtagg

SEQ ID NO: 3003 - DNA, 23 bp, Artificial
  gRNA target site sequence
aaggtaggtaatattacagaagg

SEQ ID NO: 3004 - DNA, 23 bp, Artificial
  gRNA target site sequence
gatgaactgccagcagggaacgg

SEQ ID NO: 3005 - DNA, 23 bp, Artificial
  gRNA target site sequence
cagctgatgaactgccagcaggg

SEQ ID NO: 3006 - DNA, 23 bp, Artificial
  gRNA target site sequence
ccagctgatgaactgccagcagg

SEQ ID NO: 3007 - DNA, 23 bp, Artificial
  gRNA target site sequence
tgtccagtaaggccaccatgtgg

SEQ ID NO: 3008 - DNA, 23 bp, Artificial
  gRNA target site sequence
ggcttggtctttgtccagtaagg

SEQ ID NO: 3009 - DNA, 23 bp, Artificial
  gRNA target site sequence
agtgctgaacagcaacggcttgg

SEQ ID NO: 3010 - DNA, 23 bp, Artificial
  gRNA target site sequence
cacagagtgctgaacagcaacgg

SEQ ID NO: 3011 - DNA, 23 bp, Artificial
  gRNA target site sequence
agggataaacaatagcctgcggg

SEQ ID NO: 3012 - DNA, 23 bp, Artificial
  gRNA target site sequence
aagggataaacaatagcctgcgg

SEQ ID NO: 3013 - DNA, 23 bp, Artificial
  gRNA target site sequence
ctttcgctgcttatgatgaaggg

SEQ ID NO: 3014 - DNA, 23 bp, Artificial
  gRNA target site sequence
gctttcgctgcttatgatgaagg

SEQ ID NO: 3015 - DNA, 23 bp, Artificial
  gRNA target site sequence
accagtagaagtatccttgaagg

SEQ ID NO: 3016 - DNA, 23 bp, Artificial
  gRNA target site sequence
tattgattctgcagaactgcagg

SEQ ID NO: 3017 - DNA, 23 bp, Artificial
  gRNA target site sequence
gcaggcgtatccagcacttgtgg

SEQ ID NO: 3018 - DNA, 23 bp, Artificial
  gRNA target site sequence
ggcgtatccagcacttgtggtgg

SEQ ID NO: 3019 - DNA, 23 bp, Artificial
  gRNA target site sequence
gattacttcagattatagaacgg

SEQ ID NO: 3020 - DNA, 23 bp, Artificial
  gRNA target site sequence
gattatagaacggtatccagagg

SEQ ID NO: 3021 - DNA, 23 bp, Artificial
  gRNA target site sequence
tttgagcctcatgacaaaagagg

SEQ ID NO: 3022 - DNA, 23 bp, Artificial
  gRNA target site sequence
agcctcatgacaaaagaggttgg

SEQ ID NO: 3023 - DNA, 23 bp, Artificial
  gRNA target site sequence
gttggtgtctttattctacttgg

SEQ ID NO: 3024 - DNA, 23 bp, Artificial
  gRNA target site sequence
tgcagaatcaataactatcaagg

SEQ ID NO: 3025 - DNA, 23 bp, Artificial
  gRNA target site sequence
attttctccaccacaagtgctgg

SEQ ID NO: 3026 - DNA, 23 bp, Artificial
  gRNA target site sequence
aaacttcaatctggcttcattgg

SEQ ID NO: 3027 - DNA, 23 bp, Artificial
  gRNA target site sequence
taatctaggaaacttcaatctgg

SEQ ID NO: 3028 - DNA, 23 bp, Artificial
  gRNA target site sequence
tctataatctgaagtaatctagg

SEQ ID NO: 3029 - DNA, 23 bp, Artificial
  gRNA target site sequence
atgaggctcaaagtctcctctgg

SEQ ID NO: 3030 - DNA, 23 bp, Artificial
  gRNA target site sequence
caccaacctcttttgtcatgagg

SEQ ID NO: 3031 - DNA, 23 bp, Artificial
  gRNA target site sequence
tttaggtctctgtgaattccagg

SEQ ID NO: 3032 - DNA, 23 bp, Artificial
  gRNA target site sequence
ctgtgaattccaggtgatcgcgg

SEQ ID NO: 3033 - DNA, 23 bp, Artificial
  gRNA target site sequence
tgtgaattccaggtgatcgcggg

SEQ ID NO: 3034 - DNA, 23 bp, Artificial
  gRNA target site sequence
agcattccagcacctctctgagg

SEQ ID NO: 3035 - DNA, 23 bp, Artificial
  gRNA target site sequence
gcacctctctgaggctgtgcagg

SEQ ID NO: 3036 - DNA, 23 bp, Artificial
  gRNA target site sequence
cctctctgaggctgtgcaggcgg

SEQ ID NO: 3037 - DNA, 23 bp, Artificial
  gRNA target site sequence
tgaggctgtgcaggcggctgagg

SEQ ID NO: 3038 - DNA, 23 bp, Artificial
  gRNA target site sequence
ggctgtgcaggcggctgaggagg

SEQ ID NO: 3039 - DNA, 23 bp, Artificial
  gRNA target site sequence
tgtgcaggcggctgaggaggagg

SEQ ID NO: 3040 - DNA, 23 bp, Artificial
  gRNA target site sequence
aggaggcccagcctccctcctgg

SEQ ID NO: 3041 - DNA, 23 bp, Artificial
  gRNA target site sequence
cagcctccctcctggagctgtgg

SEQ ID NO: 3042 - DNA, 23 bp, Artificial
  gRNA target site sequence
agcctccctcctggagctgtggg

SEQ ID NO: 3043 - DNA, 23 bp, Artificial
  gRNA target site sequence
tggagctgtgggcctgcagctgg

SEQ ID NO: 3044 - DNA, 23 bp, Artificial
  gRNA target site sequence
ggagctgtgggcctgcagctggg

SEQ ID NO: 3045 - DNA, 23 bp, Artificial
  gRNA target site sequence
gagctgtgggcctgcagctgggg

SEQ ID NO: 3046 - DNA, 23 bp, Artificial
  gRNA target site sequence
gattgatgcttacatgacgctgg

SEQ ID NO: 3047 - DNA, 23 bp, Artificial
  gRNA target site sequence
ctgtgaccaacagctgcgcaagg

SEQ ID NO: 3048 - DNA, 23 bp, Artificial
  gRNA target site sequence
tgaccaacagctgcgcaaggagg

SEQ ID NO: 3049 - DNA, 23 bp, Artificial
  gRNA target site sequence
aaggaggaagagaatgcatcagg

SEQ ID NO: 3050 - DNA, 23 bp, Artificial
  gRNA target site sequence
ggtacagacccgcgatcacctgg

SEQ ID NO: 3051 - DNA, 23 bp, Artificial
  gRNA target site sequence
agaggtgctggaatgctctctgg

SEQ ID NO: 3052 - DNA, 23 bp, Artificial
  gRNA target site sequence
gcacagcctcagagaggtgctgg

SEQ ID NO: 3053 - DNA, 23 bp, Artificial
  gRNA target site sequence
ccgcctgcacagcctcagagagg

SEQ ID NO: 3054 - DNA, 23 bp, Artificial
  gRNA target site sequence
acagctccaggagggaggctggg

SEQ ID NO: 3055 - DNA, 23 bp, Artificial
  gRNA target site sequence
cacagctccaggagggaggctgg

SEQ ID NO: 3056 - DNA, 23 bp, Artificial
  gRNA target site sequence
ggcccacagctccaggagggagg

SEQ ID NO: 3057 - DNA, 23 bp, Artificial
  gRNA target site sequence
gcaggcccacagctccaggaggg

SEQ ID NO: 3058 - DNA, 23 bp, Artificial
  gRNA target site sequence
tgcaggcccacagctccaggagg

SEQ ID NO: 3059 - DNA, 23 bp, Artificial
  gRNA target site sequence
agctgcaggcccacagctccagg

SEQ ID NO: 3060 - DNA, 23 bp, Artificial
  gRNA target site sequence
gcatcaatcaccccagctgcagg

SEQ ID NO: 3061 - DNA, 23 bp, Artificial
  gRNA target site sequence
cttcctccttgcgcagctgttgg

SEQ ID NO: 3062 - DNA, 23 bp, Artificial
  gRNA target site sequence
ctacttaagcaaaaatattctgg

SEQ ID NO: 3063 - DNA, 23 bp, Artificial
  gRNA target site sequence
ccgtgaccagaacattctcttgg

SEQ ID NO: 3064 - DNA, 23 bp, Artificial
  gRNA target site sequence
cgtgaccagaacattctcttggg

SEQ ID NO: 3065 - DNA, 23 bp, Artificial
  gRNA target site sequence
ttctcttgggtacaacttacagg

SEQ ID NO: 3066 - DNA, 23 bp, Artificial
  gRNA target site sequence
agcctgccttgctgaaatcgagg

SEQ ID NO: 3067 - DNA, 23 bp, Artificial
  gRNA target site sequence
ctgccttgctgaaatcgaggagg

SEQ ID NO: 3068 - DNA, 23 bp, Artificial
  gRNA target site sequence
tgctgaaatcgaggaggacaagg

SEQ ID NO: 3069 - DNA, 23 bp, Artificial
  gRNA target site sequence
agaagaatcttagagctttctgg

SEQ ID NO: 3070 - DNA, 23 bp, Artificial
  gRNA target site sequence
gctttctggatccagttcagagg

SEQ ID NO: 3071 - DNA, 23 bp, Artificial
  gRNA target site sequence
cagttcagaggattcagagaagg

SEQ ID NO: 3072 - DNA, 23 bp, Artificial
  gRNA target site sequence
ggattcagagaaggtaatactgg

SEQ ID NO: 3073 - DNA, 23 bp, Artificial
  gRNA target site sequence
ttcagagaaggtaatactggagg

SEQ ID NO: 3074 - DNA, 23 bp, Artificial
  gRNA target site sequence
gacacgttgttctcatctgttgg

SEQ ID NO: 3075 - DNA, 23 bp, Artificial
  gRNA target site sequence
ccaagagaatgttctggtcacgg

SEQ ID NO: 3076 - DNA, 23 bp, Artificial
  gRNA target site sequence
ttgtacccaagagaatgttctgg

SEQ ID NO: 3077 - DNA, 23 bp, Artificial
  gRNA target site sequence
tcgatttcagcaaggcaggctgg

SEQ ID NO: 3078 - DNA, 23 bp, Artificial
  gRNA target site sequence
ctcctcgatttcagcaaggcagg

SEQ ID NO: 3079 - DNA, 23 bp, Artificial
  gRNA target site sequence
tgtcctcctcgatttcagcaagg

SEQ ID NO: 3080 - DNA, 23 bp, Artificial
  gRNA target site sequence
cttctctgaatcctctgaactgg

SEQ ID NO: 3081 - DNA, 23 bp, Artificial
  gRNA target site sequence
acttgctatgaaactactgaagg

SEQ ID NO: 3082 - DNA, 23 bp, Artificial
  gRNA target site sequence
agtcaaaaaccagagacgattgg

SEQ ID NO: 3083 - DNA, 23 bp, Artificial
  gRNA target site sequence
aaaaaccagagacgattggctgg

SEQ ID NO: 3084 - DNA, 23 bp, Artificial
  gRNA target site sequence
gagacgattggctggtgagctgg

SEQ ID NO: 3085 - DNA, 23 bp, Artificial
  gRNA target site sequence
agacgattggctggtgagctggg

SEQ ID NO: 3086 - DNA, 23 bp, Artificial
  gRNA target site sequence
actgccgcctgagccactgccgg

SEQ ID NO: 3087 - DNA, 23 bp, Artificial
  gRNA target site sequence
gcctgagccactgccggagccgg

SEQ ID NO: 3088 - DNA, 23 bp, Artificial
  gRNA target site sequence
ccactgccggagccggtcccagg

SEQ ID NO: 3089 - DNA, 23 bp, Artificial
  gRNA target site sequence
cactgccggagccggtcccaggg

SEQ ID NO: 3090 - DNA, 23 bp, Artificial
  gRNA target site sequence
gtcccagggctgctctgagcagg

SEQ ID NO: 3091 - DNA, 23 bp, Artificial
  gRNA target site sequence
gctgaaaacagtctctttgttgg

SEQ ID NO: 3092 - DNA, 23 bp, Artificial
  gRNA target site sequence
ctgaaaacagtctctttgttggg

SEQ ID NO: 3093 - DNA, 23 bp, Artificial
  gRNA target site sequence
gctcaccagccaatcgtctctgg

SEQ ID NO: 3094 - DNA, 23 bp, Artificial
  gRNA target site sequence
ggctccggcagtggctcaggcgg

SEQ ID NO: 3095 - DNA, 23 bp, Artificial
  gRNA target site sequence
accggctccggcagtggctcagg

SEQ ID NO: 3096 - DNA, 23 bp, Artificial
  gRNA target site sequence
cctgggaccggctccggcagtgg

SEQ ID NO: 3097 - DNA, 23 bp, Artificial
  gRNA target site sequence
agcagccctgggaccggctccgg

SEQ ID NO: 3098 - DNA, 23 bp, Artificial
  gRNA target site sequence
gctcagagcagccctgggaccgg

SEQ ID NO: 3099 - DNA, 23 bp, Artificial
  gRNA target site sequence
cacctgctcagagcagccctggg

SEQ ID NO: 3100 - DNA, 23 bp, Artificial
  gRNA target site sequence
gcacctgctcagagcagccctgg

SEQ ID NO: 3101 - DNA, 23 bp, Artificial
  gRNA target site sequence
tttctttctcagcaaaatagagg

SEQ ID NO: 3102 - DNA, 23 bp, Artificial
  gRNA target site sequence
agaagataatagtatgaatgtgg

SEQ ID NO: 3103 - DNA, 23 bp, Artificial
  gRNA target site sequence
agtatgaatgtggatcaagatgg

SEQ ID NO: 3104 - DNA, 23 bp, Artificial
  gRNA target site sequence
aagatggagaccccagtgacagg

SEQ ID NO: 3105 - DNA, 23 bp, Artificial
  gRNA target site sequence
tggagaccccagtgacaggatgg

SEQ ID NO: 3106 - DNA, 23 bp, Artificial
  gRNA target site sequence
caggatggaagtgcaagagcagg

SEQ ID NO: 3107 - DNA, 23 bp, Artificial
  gRNA target site sequence
aagatatcagctccctgatcagg

SEQ ID NO: 3108 - DNA, 23 bp, Artificial
  gRNA target site sequence
tgaagatgatagacagtgcccgg

SEQ ID NO: 3109 - DNA, 23 bp, Artificial
  gRNA target site sequence
gatagacagtgcccggaagcagg

SEQ ID NO: 3110 - DNA, 23 bp, Artificial
  gRNA target site sequence
agacagtgcccggaagcaggtgg

SEQ ID NO: 3111 - DNA, 23 bp, Artificial
  gRNA target site sequence
gacagtgcccggaagcaggtggg

SEQ ID NO: 3112 - DNA, 23 bp, Artificial
  gRNA target site sequence
actattatcttctggaagagggg

SEQ ID NO: 3113 - DNA, 23 bp, Artificial
  gRNA target site sequence
tactattatcttctggaagaggg

SEQ ID NO: 3114 - DNA, 23 bp, Artificial
  gRNA target site sequence
atactattatcttctggaagagg

SEQ ID NO: 3115 - DNA, 23 bp, Artificial
  gRNA target site sequence
acattcatactattatcttctgg

SEQ ID NO: 3116 - DNA, 23 bp, Artificial
  gRNA target site sequence
gcacttccatcctgtcactgggg

SEQ ID NO: 3117 - DNA, 23 bp, Artificial
  gRNA target site sequence
tgcacttccatcctgtcactggg

SEQ ID NO: 3118 - DNA, 23 bp, Artificial
  gRNA target site sequence
ttgcacttccatcctgtcactgg

SEQ ID NO: 3119 - DNA, 23 bp, Artificial
  gRNA target site sequence
aaacttgcaactcctgatcaggg

SEQ ID NO: 3120 - DNA, 23 bp, Artificial
  gRNA target site sequence
aaaacttgcaactcctgatcagg

SEQ ID NO: 3121 - DNA, 23 bp, Artificial
  gRNA target site sequence
gtctatcatcttcattttcatgg

SEQ ID NO: 3122 - DNA, 23 bp, Artificial
  gRNA target site sequence
acgagtacccacctgcttccggg

SEQ ID NO: 3123 - DNA, 23 bp, Artificial
  gRNA target site sequence
cacgagtacccacctgcttccgg

SEQ ID NO: 3124 - DNA, 23 bp, Artificial
  gRNA target site sequence
caccctctaatactatttttagg

SEQ ID NO: 3125 - DNA, 23 bp, Artificial
  gRNA target site sequence
ttaagagacttctgaacacctgg

SEQ ID NO: 3126 - DNA, 23 bp, Artificial
  gRNA target site sequence
cagatatccagatgctaaaatgg

SEQ ID NO: 3127 - DNA, 23 bp, Artificial
  gRNA target site sequence
aaatggacccaatgaacatctgg

SEQ ID NO: 3128 - DNA, 23 bp, Artificial
  gRNA target site sequence
aatggacccaatgaacatctggg

SEQ ID NO: 3129 - DNA, 23 bp, Artificial
  gRNA target site sequence
gggatgacatcatcacaaatcgg

SEQ ID NO: 3130 - DNA, 23 bp, Artificial
  gRNA target site sequence
catcacaaatcggtaagacgtgg

SEQ ID NO: 3131 - DNA, 23 bp, Artificial
  gRNA target site sequence
tgcctaaaaatagtattagaggg

SEQ ID NO: 3132 - DNA, 23 bp, Artificial
  gRNA target site sequence
ttgcctaaaaatagtattagagg

SEQ ID NO: 3133 - DNA, 23 bp, Artificial
  gRNA target site sequence
gtgttcagaagtctcttaagggg

SEQ ID NO: 3134 - DNA, 23 bp, Artificial
  gRNA target site sequence
ggtgttcagaagtctcttaaggg

SEQ ID NO: 3135 - DNA, 23 bp, Artificial
  gRNA target site sequence
aggtgttcagaagtctcttaagg

SEQ ID NO: 3136 - DNA, 23 bp, Artificial
  gRNA target site sequence
atctggatatctgtttgtccagg

SEQ ID NO: 3137 - DNA, 23 bp, Artificial
  gRNA target site sequence
attgggtccattttagcatctgg

SEQ ID NO: 3138 - DNA, 23 bp, Artificial
  gRNA target site sequence
tgtcatcccagatgttcattggg

SEQ ID NO: 3139 - DNA, 23 bp, Artificial
  gRNA target site sequence
atgtcatcccagatgttcattgg

SEQ ID NO: 3140 - DNA, 23 bp, Artificial
  gRNA target site sequence
caccaaattgcagtctgtacagg

SEQ ID NO: 3141 - DNA, 23 bp, Artificial
  gRNA target site sequence
acaggctttaacagaaattcagg

SEQ ID NO: 3142 - DNA, 23 bp, Artificial
  gRNA target site sequence
atcagctttataagcaaacaagg

SEQ ID NO: 3143 - DNA, 23 bp, Artificial
  gRNA target site sequence
aacaaggtaatttttttcatcgg

SEQ ID NO: 3144 - DNA, 23 bp, Artificial
  gRNA target site sequence
tgagtctactttggtgtaagagg

SEQ ID NO: 3145 - DNA, 23 bp, Artificial
  gRNA target site sequence
gcaatttggtgagtctactttgg

SEQ ID NO: 3146 - DNA, 23 bp, Artificial
  gRNA target site sequence
agcctgtacagactgcaatttgg

SEQ ID NO: 3147 - DNA, 23 bp, Artificial
  gRNA target site sequence
agtatatttttatgttccttagg

SEQ ID NO: 3148 - DNA, 23 bp, Artificial
  gRNA target site sequence
caagctgaagctgctgctccagg

SEQ ID NO: 3149 - DNA, 23 bp, Artificial
  gRNA target site sequence
aagctgaagctgctgctccaggg

SEQ ID NO: 3150 - DNA, 23 bp, Artificial
  gRNA target site sequence
gaagctgctgctccagggagagg

SEQ ID NO: 3151 - DNA, 23 bp, Artificial
  gRNA target site sequence
tttattgacaaagctatgcacgg

SEQ ID NO: 3152 - DNA, 23 bp, Artificial
  gRNA target site sequence
ttattgacaaagctatgcacggg

SEQ ID NO: 3153 - DNA, 23 bp, Artificial
  gRNA target site sequence
tattgacaaagctatgcacgggg

SEQ ID NO: 3154 - DNA, 23 bp, Artificial
  gRNA target site sequence
tatgcacggggagctccagaagg

SEQ ID NO: 3155 - DNA, 23 bp, Artificial
  gRNA target site sequence
gccaaatattacattcaaaatgg

SEQ ID NO: 3156 - DNA, 23 bp, Artificial
  gRNA target site sequence
tggcattcagagttttatgcagg

SEQ ID NO: 3157 - DNA, 23 bp, Artificial
  gRNA target site sequence
taaggtagatatgtttcctaagg

SEQ ID NO: 3158 - DNA, 23 bp, Artificial
  gRNA target site sequence
agcttgctgcggatcatgtaagg

SEQ ID NO: 3159 - DNA, 23 bp, Artificial
  gRNA target site sequence
gcagcagcttcagcttgctgcgg

SEQ ID NO: 3160 - DNA, 23 bp, Artificial
  gRNA target site sequence
gggactggtcagcctctccctgg

SEQ ID NO: 3161 - DNA, 23 bp, Artificial
  gRNA target site sequence
caataaatgtcagcagggactgg

SEQ ID NO: 3162 - DNA, 23 bp, Artificial
  gRNA target site sequence
tttgtcaataaatgtcagcaggg

SEQ ID NO: 3163 - DNA, 23 bp, Artificial
  gRNA target site sequence
ctttgtcaataaatgtcagcagg

SEQ ID NO: 3164 - DNA, 23 bp, Artificial
  gRNA target site sequence
gaagctctagaatcgccttctgg

SEQ ID NO: 3165 - DNA, 23 bp, Artificial
  gRNA target site sequence
tgtcaacatcatcttgcaggagg

SEQ ID NO: 3166 - DNA, 23 bp, Artificial
  gRNA target site sequence
ctctgtcaacatcatcttgcagg

SEQ ID NO: 3167 - DNA, 23 bp, Artificial
  gRNA target site sequence
gccattttgaatgtaatatttgg

SEQ ID NO: 3168 - DNA, 23 bp, Artificial
  gRNA target site sequence
tttattaacttttctccactagg

SEQ ID NO: 3169 - DNA, 23 bp, Artificial
  gRNA target site sequence
aggctctcaataaacaagactgg

SEQ ID NO: 3170 - DNA, 23 bp, Artificial
  gRNA target site sequence
ggctctcaataaacaagactggg

SEQ ID NO: 3171 - DNA, 23 bp, Artificial
  gRNA target site sequence
aataaacaagactgggtagatgg

SEQ ID NO: 3172 - DNA, 23 bp, Artificial
  gRNA target site sequence
tgagcccacagaagccgagaagg

SEQ ID NO: 3173 - DNA, 23 bp, Artificial
  gRNA target site sequence
cagaagccgagaaggatttttgg

SEQ ID NO: 3174 - DNA, 23 bp, Artificial
  gRNA target site sequence
agaagccgagaaggatttttggg

SEQ ID NO: 3175 - DNA, 23 bp, Artificial
  gRNA target site sequence
gttacaaccaccttgctgagtgg

SEQ ID NO: 3176 - DNA, 23 bp, Artificial
  gRNA target site sequence
ccccagacctaaataaaatctgg

SEQ ID NO: 3177 - DNA, 23 bp, Artificial
  gRNA target site sequence
ctggagtgaaccattttatcagg

SEQ ID NO: 3178 - DNA, 23 bp, Artificial
  gRNA target site sequence
gagtgaaccattttatcaggtgg

SEQ ID NO: 3179 - DNA, 23 bp, Artificial
  gRNA target site sequence
agtgaaccattttatcaggtggg

SEQ ID NO: 3180 - DNA, 23 bp, Artificial
  gRNA target site sequence
cttgtttattgagagcctagtgg

SEQ ID NO: 3181 - DNA, 23 bp, Artificial
  gRNA target site sequence
aaatccttctcggcttctgtggg

SEQ ID NO: 3182 - DNA, 23 bp, Artificial
  gRNA target site sequence
aaaatccttctcggcttctgtgg

SEQ ID NO: 3183 - DNA, 23 bp, Artificial
  gRNA target site sequence
aagttcccaaaaatccttctcgg

SEQ ID NO: 3184 - DNA, 23 bp, Artificial
  gRNA target site sequence
aaggtggttgtaacagtcaaggg

SEQ ID NO: 3185 - DNA, 23 bp, Artificial
  gRNA target site sequence
caaggtggttgtaacagtcaagg

SEQ ID NO: 3186 - DNA, 23 bp, Artificial
  gRNA target site sequence
gtgatttccactcagcaaggtgg

SEQ ID NO: 3187 - DNA, 23 bp, Artificial
  gRNA target site sequence
caagtgatttccactcagcaagg

SEQ ID NO: 3188 - DNA, 23 bp, Artificial
  gRNA target site sequence
ggggttctcactgtctatactgg

SEQ ID NO: 3189 - DNA, 23 bp, Artificial
  gRNA target site sequence
agattttatttaggtctgggggg

SEQ ID NO: 3190 - DNA, 23 bp, Artificial
  gRNA target site sequence
cagattttatttaggtctggggg

SEQ ID NO: 3191 - DNA, 23 bp, Artificial
  gRNA target site sequence
ccagattttatttaggtctgggg

SEQ ID NO: 3192 - DNA, 23 bp, Artificial
  gRNA target site sequence
tccagattttatttaggtctggg

SEQ ID NO: 3193 - DNA, 23 bp, Artificial
  gRNA target site sequence
ctccagattttatttaggtctgg

SEQ ID NO: 3194 - DNA, 23 bp, Artificial
  gRNA target site sequence
gttcactccagattttatttagg

SEQ ID NO: 3195 - DNA, 23 bp, Artificial
  gRNA target site sequence
attttacccacctgataaaatgg

SEQ ID NO: 3196 - DNA, 23 bp, Artificial
  gRNA target site sequence
gcctttttgatttgttttgtagg

SEQ ID NO: 3197 - DNA, 23 bp, Artificial
  gRNA target site sequence
tgtaggctgtatagatcaattgg

SEQ ID NO: 3198 - DNA, 23 bp, Artificial
  gRNA target site sequence
ggagaatacgacgtcctccgtgg

SEQ ID NO: 3199 - DNA, 23 bp, Artificial
  gRNA target site sequence
gagaatacgacgtcctccgtggg

SEQ ID NO: 3200 - DNA, 23 bp, Artificial
  gRNA target site sequence
gggatttttaccagtgagatagg

SEQ ID NO: 3201 - DNA, 23 bp, Artificial
  gRNA target site sequence
agctgctaagcagtatgatgagg

SEQ ID NO: 3202 - DNA, 23 bp, Artificial
  gRNA target site sequence
gatgaggtaaaattgatctctgg

SEQ ID NO: 3203 - DNA, 23 bp, Artificial
  gRNA target site sequence
gcctacaaaacaaatcaaaaagg

SEQ ID NO: 3204 - DNA, 23 bp, Artificial
  gRNA target site sequence
cactggtaaaaatcccacggagg

SEQ ID NO: 3205 - DNA, 23 bp, Artificial
  gRNA target site sequence
tctcactggtaaaaatcccacgg

SEQ ID NO: 3206 - DNA, 23 bp, Artificial
  gRNA target site sequence
ttgctttgttcctatctcactgg

SEQ ID NO: 3207 - DNA, 23 bp, Artificial
  gRNA target site sequence
agcttcagaataatcacttctgg

SEQ ID NO: 3208 - DNA, 23 bp, Artificial
  gRNA target site sequence
ggttgtatgtgtggtttcacagg

SEQ ID NO: 3209 - DNA, 23 bp, Artificial
  gRNA target site sequence
cctgctgagcctcgacccagcgg

SEQ ID NO: 3210 - DNA, 23 bp, Artificial
  gRNA target site sequence
gacccagcggctgttagcgctgg

SEQ ID NO: 3211 - DNA, 23 bp, Artificial
  gRNA target site sequence
ggctgttagcgctggttgcctgg

SEQ ID NO: 3212 - DNA, 23 bp, Artificial
  gRNA target site sequence
ggccagcctacagcagcccgtgg

SEQ ID NO: 3213 - DNA, 23 bp, Artificial
  gRNA target site sequence
gccagcctacagcagcccgtggg

SEQ ID NO: 3214 - DNA, 23 bp, Artificial
  gRNA target site sequence
cgtgggcatccgcctgctagagg

SEQ ID NO: 3215 - DNA, 23 bp, Artificial
  gRNA target site sequence
gggcatccgcctgctagaggagg

SEQ ID NO: 3216 - DNA, 23 bp, Artificial
  gRNA target site sequence
ctgcctgccaagcgagtccgtgg

SEQ ID NO: 3217 - DNA, 23 bp, Artificial
  gRNA target site sequence
tgcctgccaagcgagtccgtggg

SEQ ID NO: 3218 - DNA, 23 bp, Artificial
  gRNA target site sequence
tgccaagcgagtccgtgggaagg

SEQ ID NO: 3219 - DNA, 23 bp, Artificial
  gRNA target site sequence
tccctcctgatgtcctcagatgg

SEQ ID NO: 3220 - DNA, 23 bp, Artificial
  gRNA target site sequence
ccctcctgatgtcctcagatggg

SEQ ID NO: 3221 - DNA, 23 bp, Artificial
  gRNA target site sequence
tcctgatgtcctcagatgggtgg

SEQ ID NO: 3222 - DNA, 23 bp, Artificial
  gRNA target site sequence
gagcttgctaagtaagtgtgagg

SEQ ID NO: 3223 - DNA, 23 bp, Artificial
  gRNA target site sequence
tgctaagtaagtgtgaggtcagg

SEQ ID NO: 3224 - DNA, 23 bp, Artificial
  gRNA target site sequence
cgctgggtcgaggctcagcaggg

SEQ ID NO: 3225 - DNA, 23 bp, Artificial
  gRNA target site sequence
ccgctgggtcgaggctcagcagg

SEQ ID NO: 3226 - DNA, 23 bp, Artificial
  gRNA target site sequence
cgctaacagccgctgggtcgagg

SEQ ID NO: 3227 - DNA, 23 bp, Artificial
  gRNA target site sequence
aaccagcgctaacagccgctggg

SEQ ID NO: 3228 - DNA, 23 bp, Artificial
  gRNA target site sequence
caaccagcgctaacagccgctgg

SEQ ID NO: 3229 - DNA, 23 bp, Artificial
  gRNA target site sequence
cgggctgctgtaggctggccagg

SEQ ID NO: 3230 - DNA, 23 bp, Artificial
  gRNA target site sequence
gcccacgggctgctgtaggctgg

SEQ ID NO: 3231 - DNA, 23 bp, Artificial
  gRNA target site sequence
ggatgcccacgggctgctgtagg

SEQ ID NO: 3232 - DNA, 23 bp, Artificial
  gRNA target site sequence
tctagcaggcggatgcccacggg

SEQ ID NO: 3233 - DNA, 23 bp, Artificial
  gRNA target site sequence
ctctagcaggcggatgcccacgg

SEQ ID NO: 3234 - DNA, 23 bp, Artificial
  gRNA target site sequence
gcagagcctcctctagcaggcgg

SEQ ID NO: 3235 - DNA, 23 bp, Artificial
  gRNA target site sequence
ggagcagagcctcctctagcagg

SEQ ID NO: 3236 - DNA, 23 bp, Artificial
  gRNA target site sequence
gcagctcagcaggcagcaggcgg

SEQ ID NO: 3237 - DNA, 23 bp, Artificial
  gRNA target site sequence
caggcagctcagcaggcagcagg

SEQ ID NO: 3238 - DNA, 23 bp, Artificial
  gRNA target site sequence
cgcttggcaggcagctcagcagg

SEQ ID NO: 3239 - DNA, 23 bp, Artificial
  gRNA target site sequence
ttcccacggactcgcttggcagg

SEQ ID NO: 3240 - DNA, 23 bp, Artificial
  gRNA target site sequence
ggccttcccacggactcgcttgg

SEQ ID NO: 3241 - DNA, 23 bp, Artificial
  gRNA target site sequence
gagggaggcgggccttcccacgg

SEQ ID NO: 3242 - DNA, 23 bp, Artificial
  gRNA target site sequence
gaggacatcaggagggaggcggg

SEQ ID NO: 3243 - DNA, 23 bp, Artificial
  gRNA target site sequence
tgaggacatcaggagggaggcgg

SEQ ID NO: 3244 - DNA, 23 bp, Artificial
  gRNA target site sequence
atctgaggacatcaggagggagg

SEQ ID NO: 3245 - DNA, 23 bp, Artificial
  gRNA target site sequence
cccatctgaggacatcaggaggg

SEQ ID NO: 3246 - DNA, 23 bp, Artificial
  gRNA target site sequence
acccatctgaggacatcaggagg

SEQ ID NO: 3247 - DNA, 23 bp, Artificial
  gRNA target site sequence
tccacccatctgaggacatcagg

SEQ ID NO: 3248 - DNA, 23 bp, Artificial
  gRNA target site sequence
tagcaagctccacccatctgagg

SEQ ID NO: 3249 - DNA, 23 bp, Artificial
  gRNA target site sequence
ttgttttgaattttttacagagg

SEQ ID NO: 3250 - DNA, 23 bp, Artificial
  gRNA target site sequence
tgttttgaattttttacagaggg

SEQ ID NO: 3251 - DNA, 23 bp, Artificial
  gRNA target site sequence
ctctttagcagcttgttttctgg

SEQ ID NO: 3252 - DNA, 23 bp, Artificial
  gRNA target site sequence
ttctggaattttgaaagagatgg

SEQ ID NO: 3253 - DNA, 23 bp, Artificial
  gRNA target site sequence
accctttgtctcttgtattcagg

SEQ ID NO: 3254 - DNA, 23 bp, Artificial
  gRNA target site sequence
agagctgttttgcaattattggg

SEQ ID NO: 3255 - DNA, 23 bp, Artificial
  gRNA target site sequence
aagagctgttttgcaattattgg

SEQ ID NO: 3256 - DNA, 23 bp, Artificial
  gRNA target site sequence
gggtggaaagaaagagaaggtgg

SEQ ID NO: 3257 - DNA, 23 bp, Artificial
  gRNA target site sequence
aaagggtggaaagaaagagaagg

SEQ ID NO: 3258 - DNA, 23 bp, Artificial
  gRNA target site sequence
tgaatacaagagacaaagggtgg

SEQ ID NO: 3259 - DNA, 23 bp, Artificial
  gRNA target site sequence
acctgaatacaagagacaaaggg

SEQ ID NO: 3260 - DNA, 23 bp, Artificial
  gRNA target site sequence
tacctgaatacaagagacaaagg

SEQ ID NO: 3261 - DNA, 23 bp, Artificial
  gRNA target site sequence
tctttggttctggtgcttatagg

SEQ ID NO: 3262 - DNA, 23 bp, Artificial
  gRNA target site sequence
gagtgagttaaaaatgaagcagg

SEQ ID NO: 3263 - DNA, 23 bp, Artificial
  gRNA target site sequence
aaaaatgaagcaggatgcccagg

SEQ ID NO: 3264 - DNA, 23 bp, Artificial
  gRNA target site sequence
tcgttctgtacagaagctaccgg

SEQ ID NO: 3265 - DNA, 23 bp, Artificial
  gRNA target site sequence
ctgtacagaagctaccggcacgg

SEQ ID NO: 3266 - DNA, 23 bp, Artificial
  gRNA target site sequence
cagcctcatcaccccgttacagg

SEQ ID NO: 3267 - DNA, 23 bp, Artificial
  gRNA target site sequence
catcaccccgttacaggccgtgg

SEQ ID NO: 3268 - DNA, 23 bp, Artificial
  gRNA target site sequence
cccgttacaggccgtggcccagg

SEQ ID NO: 3269 - DNA, 23 bp, Artificial
  gRNA target site sequence
gcttctgtacagaacgacctggg

SEQ ID NO: 3270 - DNA, 23 bp, Artificial
  gRNA target site sequence
agcttctgtacagaacgacctgg

SEQ ID NO: 3271 - DNA, 23 bp, Artificial
  gRNA target site sequence
tgtcaggaaggtctccgtgccgg

SEQ ID NO: 3272 - DNA, 23 bp, Artificial
  gRNA target site sequence
gcttgatctgaatgtcaggaagg

SEQ ID NO: 3273 - DNA, 23 bp, Artificial
  gRNA target site sequence
ctgtgcttgatctgaatgtcagg

SEQ ID NO: 3274 - DNA, 23 bp, Artificial
  gRNA target site sequence
cggcctgtaacggggtgatgagg

SEQ ID NO: 3275 - DNA, 23 bp, Artificial
  gRNA target site sequence
ctgggccacggcctgtaacgggg

SEQ ID NO: 3276 - DNA, 23 bp, Artificial
  gRNA target site sequence
cctgggccacggcctgtaacggg

SEQ ID NO: 3277 - DNA, 23 bp, Artificial
  gRNA target site sequence
acctgggccacggcctgtaacgg

SEQ ID NO: 3278 - DNA, 23 bp, Artificial
  gRNA target site sequence
gcaaaaactgacctgggccacgg

SEQ ID NO: 3279 - DNA, 23 bp, Artificial
  gRNA target site sequence
gcagcggcaaaaactgacctggg

SEQ ID NO: 3280 - DNA, 23 bp, Artificial
  gRNA target site sequence
cgcagcggcaaaaactgacctgg

SEQ ID NO: 3281 - DNA, 23 bp, Artificial
  gRNA target site sequence
tgggcctgctttccctctccagg

SEQ ID NO: 3282 - DNA, 23 bp, Artificial
  gRNA target site sequence
ctgctttccctctccaggtgcgg

SEQ ID NO: 3283 - DNA, 23 bp, Artificial
  gRNA target site sequence
tttccctctccaggtgcggccgg

SEQ ID NO: 3284 - DNA, 23 bp, Artificial
  gRNA target site sequence
cctctccaggtgcggccggccgg

SEQ ID NO: 3285 - DNA, 23 bp, Artificial
  gRNA target site sequence
tccaggtgcggccggccggacgg

SEQ ID NO: 3286 - DNA, 23 bp, Artificial
  gRNA target site sequence
acctactacgactgcgcagacgg

SEQ ID NO: 3287 - DNA, 23 bp, Artificial
  gRNA target site sequence
gactgcgcagacggtttatgagg

SEQ ID NO: 3288 - DNA, 23 bp, Artificial
  gRNA target site sequence
actgcgcagacggtttatgaggg

SEQ ID NO: 3289 - DNA, 23 bp, Artificial
  gRNA target site sequence
cagacggtttatgagggaccagg

SEQ ID NO: 3290 - DNA, 23 bp, Artificial
  gRNA target site sequence
agtttgatgtatgccagaaaagg

SEQ ID NO: 3291 - DNA, 23 bp, Artificial
  gRNA target site sequence
tgctgagcaaaaacgagagaagg

SEQ ID NO: 3292 - DNA, 23 bp, Artificial
  gRNA target site sequence
cgcacctggagagggaaagcagg

SEQ ID NO: 3293 - DNA, 23 bp, Artificial
  gRNA target site sequence
cggccggccgcacctggagaggg

SEQ ID NO: 3294 - DNA, 23 bp, Artificial
  gRNA target site sequence
ccggccggccgcacctggagagg

SEQ ID NO: 3295 - DNA, 23 bp, Artificial
  gRNA target site sequence
tccgtccggccggccgcacctgg

SEQ ID NO: 3296 - DNA, 23 bp, Artificial
  gRNA target site sequence
tcgtagtaggtccgtccggccgg

SEQ ID NO: 3297 - DNA, 23 bp, Artificial
  gRNA target site sequence
gcagtcgtagtaggtccgtccgg

SEQ ID NO: 3298 - DNA, 23 bp, Artificial
  gRNA target site sequence
accgtctgcgcagtcgtagtagg

SEQ ID NO: 3299 - DNA, 23 bp, Artificial
  gRNA target site sequence
acatcaaactgagcttctcctgg

SEQ ID NO: 3300 - DNA, 23 bp, Artificial
  gRNA target site sequence
ttgctcagcaacgccttttctgg

SEQ ID NO: 3301 - DNA, 23 bp, Artificial
  gRNA target site sequence
ctctgattgcatgtcacagatgg

SEQ ID NO: 3302 - DNA, 23 bp, Artificial
  gRNA target site sequence
atggaagaagctcatttgattgg

SEQ ID NO: 3303 - DNA, 23 bp, Artificial
  gRNA target site sequence
agctcatttgattggctgaccgg

SEQ ID NO: 3304 - DNA, 23 bp, Artificial
  gRNA target site sequence
gctcatttgattggctgaccggg

SEQ ID NO: 3305 - DNA, 23 bp, Artificial
  gRNA target site sequence
cgggagcagcactgacccgctgg

SEQ ID NO: 3306 - DNA, 23 bp, Artificial
  gRNA target site sequence
ccttgctgtttgcccacaagagg

SEQ ID NO: 3307 - DNA, 23 bp, Artificial
  gRNA target site sequence
ttgcccacaagaggagtgaaagg

SEQ ID NO: 3308 - DNA, 23 bp, Artificial
  gRNA target site sequence
gagagcacccttgaagtcagtgg

SEQ ID NO: 3309 - DNA, 23 bp, Artificial
  gRNA target site sequence
agagcacccttgaagtcagtggg

SEQ ID NO: 3310 - DNA, 23 bp, Artificial
  gRNA target site sequence
gagcacccttgaagtcagtgggg

SEQ ID NO: 3311 - DNA, 23 bp, Artificial
  gRNA target site sequence
aagtcagtggggcctgattttgg

SEQ ID NO: 3312 - DNA, 23 bp, Artificial
  gRNA target site sequence
agtcagtggggcctgattttggg

SEQ ID NO: 3313 - DNA, 23 bp, Artificial
  gRNA target site sequence
ggcctgattttgggaaaaaaagg

SEQ ID NO: 3314 - DNA, 23 bp, Artificial
  gRNA target site sequence
tgattttgggaaaaaaaggctgg

SEQ ID NO: 3315 - DNA, 23 bp, Artificial
  gRNA target site sequence
gattttgggaaaaaaaggctggg

SEQ ID NO: 3316 - DNA, 23 bp, Artificial
  gRNA target site sequence
aaaaaaaggctgggccttccagg

SEQ ID NO: 3317 - DNA, 23 bp, Artificial
  gRNA target site sequence
aaaaaaggctgggccttccaggg

SEQ ID NO: 3318 - DNA, 23 bp, Artificial
  gRNA target site sequence
aaaaaggctgggccttccagggg

SEQ ID NO: 3319 - DNA, 23 bp, Artificial
  gRNA target site sequence
gctgggccttccaggggacgagg

SEQ ID NO: 3320 - DNA, 23 bp, Artificial
  gRNA target site sequence
gggccttccaggggacgaggtgg

SEQ ID NO: 3321 - DNA, 23 bp, Artificial
  gRNA target site sequence
gaggtggataacaaagtgaaagg

SEQ ID NO: 3322 - DNA, 23 bp, Artificial
  gRNA target site sequence
taacaaagtgaaaggtaagctgg

SEQ ID NO: 3323 - DNA, 23 bp, Artificial
  gRNA target site sequence
aacaaagtgaaaggtaagctggg

SEQ ID NO: 3324 - DNA, 23 bp, Artificial
  gRNA target site sequence
tctgtgacatgcaatcagagagg

SEQ ID NO: 3325 - DNA, 23 bp, Artificial
  gRNA target site sequence
cagcgggtcagtgctgctcccgg

SEQ ID NO: 3326 - DNA, 23 bp, Artificial
  gRNA target site sequence
gactggtgtggtcgaccagcggg

SEQ ID NO: 3327 - DNA, 23 bp, Artificial
  gRNA target site sequence
ggactggtgtggtcgaccagcgg

SEQ ID NO: 3328 - DNA, 23 bp, Artificial
  gRNA target site sequence
agtcagatgagggactggtgtgg

SEQ ID NO: 3329 - DNA, 23 bp, Artificial
  gRNA target site sequence
caaggagtcagatgagggactgg

SEQ ID NO: 3330 - DNA, 23 bp, Artificial
  gRNA target site sequence
aacagcaaggagtcagatgaggg

SEQ ID NO: 3331 - DNA, 23 bp, Artificial
  gRNA target site sequence
aaacagcaaggagtcagatgagg

SEQ ID NO: 3332 - DNA, 23 bp, Artificial
  gRNA target site sequence
cctcttgtgggcaaacagcaagg

SEQ ID NO: 3333 - DNA, 23 bp, Artificial
  gRNA target site sequence
taacctttcactcctcttgtggg

SEQ ID NO: 3334 - DNA, 23 bp, Artificial
  gRNA target site sequence
gtaacctttcactcctcttgtgg

SEQ ID NO: 3335 - DNA, 23 bp, Artificial
  gRNA target site sequence
tcaggccccactgacttcaaggg

SEQ ID NO: 3336 - DNA, 23 bp, Artificial
  gRNA target site sequence
atcaggccccactgacttcaagg

SEQ ID NO: 3337 - DNA, 23 bp, Artificial
  gRNA target site sequence
agcctttttttcccaaaatcagg

SEQ ID NO: 3338 - DNA, 23 bp, Artificial
  gRNA target site sequence
tatccacctcgtcccctggaagg

SEQ ID NO: 3339 - DNA, 23 bp, Artificial
  gRNA target site sequence
ttgttatccacctcgtcccctgg

SEQ ID NO: 3340 - DNA, 23 bp, Artificial
  gRNA target site sequence
tttgaaactttcttatgtacagg

SEQ ID NO: 3341 - DNA, 23 bp, Artificial
  gRNA target site sequence
aatataccattgattctgattgg

SEQ ID NO: 3342 - DNA, 23 bp, Artificial
  gRNA target site sequence
tgttctcactccgatgtttgtgg

SEQ ID NO: 3343 - DNA, 23 bp, Artificial
  gRNA target site sequence
tccgatgtttgtggagacccagg

SEQ ID NO: 3344 - DNA, 23 bp, Artificial
  gRNA target site sequence
tgtggagacccaggcctcccagg

SEQ ID NO: 3345 - DNA, 23 bp, Artificial
  gRNA target site sequence
gtggagacccaggcctcccaggg

SEQ ID NO: 3346 - DNA, 23 bp, Artificial
  gRNA target site sequence
cactctccagacccgtacccagg

SEQ ID NO: 3347 - DNA, 23 bp, Artificial
  gRNA target site sequence
ctccagacccgtacccaggaagg

SEQ ID NO: 3348 - DNA, 23 bp, Artificial
  gRNA target site sequence
tccagacccgtacccaggaaggg

SEQ ID NO: 3349 - DNA, 23 bp, Artificial
  gRNA target site sequence
aagggtccctctcagctcgctgg

SEQ ID NO: 3350 - DNA, 23 bp, Artificial
  gRNA target site sequence
cctctcagctcgctggccagtgg

SEQ ID NO: 3351 - DNA, 23 bp, Artificial
  gRNA target site sequence
tcagctcgctggccagtggcagg

SEQ ID NO: 3352 - DNA, 23 bp, Artificial
  gRNA target site sequence
cagctcgctggccagtggcaggg

SEQ ID NO: 3353 - DNA, 23 bp, Artificial
  gRNA target site sequence
ggccagtggcagggcagataagg

SEQ ID NO: 3354 - DNA, 23 bp, Artificial
  gRNA target site sequence
gccagtggcagggcagataaggg

SEQ ID NO: 3355 - DNA, 23 bp, Artificial
  gRNA target site sequence
ttcacactgacacagactgcagg

SEQ ID NO: 3356 - DNA, 23 bp, Artificial
  gRNA target site sequence
gtaacagtgaccctgcccgctgg

SEQ ID NO: 3357 - DNA, 23 bp, Artificial
  gRNA target site sequence
gaaacgccaatcagaatcaatgg

SEQ ID NO: 3358 - DNA, 23 bp, Artificial
  gRNA target site sequence
tcggagtgagaacagtacttcgg

SEQ ID NO: 3359 - DNA, 23 bp, Artificial
  gRNA target site sequence
gcctgggtctccacaaacatcgg

SEQ ID NO: 3360 - DNA, 23 bp, Artificial
  gRNA target site sequence
gagagtgccctgggaggcctggg

SEQ ID NO: 3361 - DNA, 23 bp, Artificial
  gRNA target site sequence
ggagagtgccctgggaggcctgg

SEQ ID NO: 3362 - DNA, 23 bp, Artificial
  gRNA target site sequence
ggtctggagagtgccctgggagg

SEQ ID NO: 3363 - DNA, 23 bp, Artificial
  gRNA target site sequence
acgggtctggagagtgccctggg

SEQ ID NO: 3364 - DNA, 23 bp, Artificial
  gRNA target site sequence
tacgggtctggagagtgccctgg

SEQ ID NO: 3365 - DNA, 23 bp, Artificial
  gRNA target site sequence
acccttcctgggtacgggtctgg

SEQ ID NO: 3366 - DNA, 23 bp, Artificial
  gRNA target site sequence
gagggacccttcctgggtacggg

SEQ ID NO: 3367 - DNA, 23 bp, Artificial
  gRNA target site sequence
agagggacccttcctgggtacgg

SEQ ID NO: 3368 - DNA, 23 bp, Artificial
  gRNA target site sequence
agctgagagggacccttcctggg

SEQ ID NO: 3369 - DNA, 23 bp, Artificial
  gRNA target site sequence
gagctgagagggacccttcctgg

SEQ ID NO: 3370 - DNA, 23 bp, Artificial
  gRNA target site sequence
cactggccagcgagctgagaggg

SEQ ID NO: 3371 - DNA, 23 bp, Artificial
  gRNA target site sequence
ccactggccagcgagctgagagg

SEQ ID NO: 3372 - DNA, 23 bp, Artificial
  gRNA target site sequence
gcccttatctgccctgccactgg

SEQ ID NO: 3373 - DNA, 23 bp, Artificial
  gRNA target site sequence
gaagtcatgctgctgctgggtgg

SEQ ID NO: 3374 - DNA, 23 bp, Artificial
  gRNA target site sequence
tgtgaagtcatgctgctgctggg

SEQ ID NO: 3375 - DNA, 23 bp, Artificial
  gRNA target site sequence
gtgtgaagtcatgctgctgctgg

SEQ ID NO: 3376 - DNA, 23 bp, Artificial
  gRNA target site sequence
gattaattattcgaaatttctgg

SEQ ID NO: 3377 - DNA, 23 bp, Artificial
  gRNA target site sequence
atttctggagccatgaaactagg

SEQ ID NO: 3378 - DNA, 23 bp, Artificial
  gRNA target site sequence
taggttaccttcaaataccttgg

SEQ ID NO: 3379 - DNA, 23 bp, Artificial
  gRNA target site sequence
taccttcaaataccttggaccgg

SEQ ID NO: 3380 - DNA, 23 bp, Artificial
  gRNA target site sequence
aaataccttggaccggttgctgg

SEQ ID NO: 3381 - DNA, 23 bp, Artificial
  gRNA target site sequence
tctgtcagaatgcgaatttcagg

SEQ ID NO: 3382 - DNA, 23 bp, Artificial
  gRNA target site sequence
aatgcgaatttcaggtaatgtgg

SEQ ID NO: 3383 - DNA, 23 bp, Artificial
  gRNA target site sequence
ttgaaggtaacctagtttcatgg

SEQ ID NO: 3384 - DNA, 23 bp, Artificial
  gRNA target site sequence
aaccggtccaaggtatttgaagg

SEQ ID NO: 3385 - DNA, 23 bp, Artificial
  gRNA target site sequence
tagtgccagcaaccggtccaagg

SEQ ID NO: 3386 - DNA, 23 bp, Artificial
  gRNA target site sequence
aggaatttagtgccagcaaccgg

SEQ ID NO: 3387 - DNA, 23 bp, Artificial
  gRNA target site sequence
ttctatcttaggagaatataagg

SEQ ID NO: 3388 - DNA, 23 bp, Artificial
  gRNA target site sequence
aaaaagtgcacttctatcttagg

SEQ ID NO: 3389 - DNA, 23 bp, Artificial
  gRNA target site sequence
tggataatctgggctcatgctgg

SEQ ID NO: 3390 - DNA, 23 bp, Artificial
  gRNA target site sequence
acatggggtttggataatctggg

SEQ ID NO: 3391 - DNA, 23 bp, Artificial
  gRNA target site sequence
aacatggggtttggataatctgg

SEQ ID NO: 3392 - DNA, 23 bp, Artificial
  gRNA target site sequence
ggatgctcgaacatggggtttgg

SEQ ID NO: 3393 - DNA, 23 bp, Artificial
  gRNA target site sequence
acagaggatgctcgaacatgggg

SEQ ID NO: 3394 - DNA, 23 bp, Artificial
  gRNA target site sequence
gacagaggatgctcgaacatggg

SEQ ID NO: 3395 - DNA, 23 bp, Artificial
  gRNA target site sequence
tgacagaggatgctcgaacatgg

SEQ ID NO: 3396 - DNA, 23 bp, Artificial
  gRNA target site sequence
tgaaattcgcattctgacagagg

SEQ ID NO: 3397 - DNA, 23 bp, Artificial
  gRNA target site sequence
tgagacagataatgactcccagg

SEQ ID NO: 3398 - DNA, 23 bp, Artificial
  gRNA target site sequence
ctcccaggaaatatttaagttgg

SEQ ID NO: 3399 - DNA, 23 bp, Artificial
  gRNA target site sequence
gcaaaagatgtgctgattcaagg

SEQ ID NO: 3400 - DNA, 23 bp, Artificial
  gRNA target site sequence
ggattgatcgatgagaaccctgg

SEQ ID NO: 3401 - DNA, 23 bp, Artificial
  gRNA target site sequence
gacttcagtacgtgaataactgg

SEQ ID NO: 3402 - DNA, 23 bp, Artificial
  gRNA target site sequence
acttcagtacgtgaataactggg

SEQ ID NO: 3403 - DNA, 23 bp, Artificial
  gRNA target site sequence
cagtacgtgaataactgggctgg

SEQ ID NO: 3404 - DNA, 23 bp, Artificial
  gRNA target site sequence
agtacgtgaataactgggctggg

SEQ ID NO: 3405 - DNA, 23 bp, Artificial
  gRNA target site sequence
tcattatctgtctcactttctgg

SEQ ID NO: 3406 - DNA, 23 bp, Artificial
  gRNA target site sequence
tgccaacttaaatatttcctggg

SEQ ID NO: 3407 - DNA, 23 bp, Artificial
  gRNA target site sequence
ttgccaacttaaatatttcctgg

SEQ ID NO: 3408 - DNA, 23 bp, Artificial
  gRNA target site sequence
tattcacgtactgaagtccaggg

SEQ ID NO: 3409 - DNA, 23 bp, Artificial
  gRNA target site sequence
ttattcacgtactgaagtccagg

SEQ ID NO: 3410 - DNA, 23 bp, Artificial
  gRNA target site sequence
tgaaagacaaaaagtatgtttgg

SEQ ID NO: 3411 - DNA, 23 bp, Artificial
  gRNA target site sequence
agaacttctgaaccccgttgtgg

SEQ ID NO: 3412 - DNA, 23 bp, Artificial
  gRNA target site sequence
cccatccttctacaacatgtagg

SEQ ID NO: 3413 - DNA, 23 bp, Artificial
  gRNA target site sequence
ccatccttctacaacatgtaggg

SEQ ID NO: 3414 - DNA, 23 bp, Artificial
  gRNA target site sequence
aaatgtataatattctcatgtgg

SEQ ID NO: 3415 - DNA, 23 bp, Artificial
  gRNA target site sequence
tgtggattcatgataattacagg

SEQ ID NO: 3416 - DNA, 23 bp, Artificial
  gRNA target site sequence
ttgtctttcatcatctctatggg

SEQ ID NO: 3417 - DNA, 23 bp, Artificial
  gRNA target site sequence
tttgtctttcatcatctctatgg

SEQ ID NO: 3418 - DNA, 23 bp, Artificial
  gRNA target site sequence
agttctactggttttaactttgg

SEQ ID NO: 3419 - DNA, 23 bp, Artificial
  gRNA target site sequence
agaagttctcggagttctactgg

SEQ ID NO: 3420 - DNA, 23 bp, Artificial
  gRNA target site sequence
caacggggttcagaagttctcgg

SEQ ID NO: 3421 - DNA, 23 bp, Artificial
  gRNA target site sequence
gggaaacgaattccacaacgggg

SEQ ID NO: 3422 - DNA, 23 bp, Artificial
  gRNA target site sequence
tgggaaacgaattccacaacggg

SEQ ID NO: 3423 - DNA, 23 bp, Artificial
  gRNA target site sequence
atgggaaacgaattccacaacgg

SEQ ID NO: 3424 - DNA, 23 bp, Artificial
  gRNA target site sequence
cctacatgttgtagaaggatggg

SEQ ID NO: 3425 - DNA, 23 bp, Artificial
  gRNA target site sequence
ccctacatgttgtagaaggatgg

SEQ ID NO: 3426 - DNA, 23 bp, Artificial
  gRNA target site sequence
tgttccctacatgttgtagaagg

SEQ ID NO: 3427 - DNA, 23 bp, Artificial
  gRNA target site sequence
caccagttcccttccccgccagg

SEQ ID NO: 3428 - DNA, 23 bp, Artificial
  gRNA target site sequence
tttctgctgccaaaatttcatgg

SEQ ID NO: 3429 - DNA, 23 bp, Artificial
  gRNA target site sequence
agtgttgaaaacactctgtctgg

SEQ ID NO: 3430 - DNA, 23 bp, Artificial
  gRNA target site sequence
gttgaaaacactctgtctggagg

SEQ ID NO: 3431 - DNA, 23 bp, Artificial
  gRNA target site sequence
gaaaacactctgtctggaggtgg

SEQ ID NO: 3432 - DNA, 23 bp, Artificial
  gRNA target site sequence
ggaggtggtactttgtcgtgtgg

SEQ ID NO: 3433 - DNA, 23 bp, Artificial
  gRNA target site sequence
ggtggtactttgtcgtgtggagg

SEQ ID NO: 3434 - DNA, 23 bp, Artificial
  gRNA target site sequence
gtggtactttgtcgtgtggaggg

SEQ ID NO: 3435 - DNA, 23 bp, Artificial
  gRNA target site sequence
gtacttccagttaaagagcaagg

SEQ ID NO: 3436 - DNA, 23 bp, Artificial
  gRNA target site sequence
tcgttcaagtcatgagacatagg

SEQ ID NO: 3437 - DNA, 23 bp, Artificial
  gRNA target site sequence
aacctggcggggaagggaactgg

SEQ ID NO: 3438 - DNA, 23 bp, Artificial
  gRNA target site sequence
ttcatgaacctggcggggaaggg

SEQ ID NO: 3439 - DNA, 23 bp, Artificial
  gRNA target site sequence
attcatgaacctggcggggaagg

SEQ ID NO: 3440 - DNA, 23 bp, Artificial
  gRNA target site sequence
cagcattcatgaacctggcgggg

SEQ ID NO: 3441 - DNA, 23 bp, Artificial
  gRNA target site sequence
acagcattcatgaacctggcggg

SEQ ID NO: 3442 - DNA, 23 bp, Artificial
  gRNA target site sequence
cacagcattcatgaacctggcgg

SEQ ID NO: 3443 - DNA, 23 bp, Artificial
  gRNA target site sequence
gaacacagcattcatgaacctgg

SEQ ID NO: 3444 - DNA, 23 bp, Artificial
  gRNA target site sequence
ttcaacactccatgaaattttgg

SEQ ID NO: 3445 - DNA, 23 bp, Artificial
  gRNA target site sequence
cgaagtccttgctctttaactgg

SEQ ID NO: 3446 - DNA, 23 bp, Artificial
  gRNA target site sequence
aaacttaatttttcagatactgg

SEQ ID NO: 3447 - DNA, 23 bp, Artificial
  gRNA target site sequence
cttaatttttcagatactggagg

SEQ ID NO: 3448 - DNA, 23 bp, Artificial
  gRNA target site sequence
ggaggagtctctgtgtgaactgg

SEQ ID NO: 3449 - DNA, 23 bp, Artificial
  gRNA target site sequence
gaagcaacatcagaatactatgg

SEQ ID NO: 3450 - DNA, 23 bp, Artificial
  gRNA target site sequence
gcaacatcagaatactatggagg

SEQ ID NO: 3451 - DNA, 23 bp, Artificial
  gRNA target site sequence
gcttccctcctcttgcagacagg

SEQ ID NO: 3452 - DNA, 23 bp, Artificial
  gRNA target site sequence
cctcctcttgcagacaggtatgg

SEQ ID NO: 3453 - DNA, 23 bp, Artificial
  gRNA target site sequence
ctcctcttgcagacaggtatggg

SEQ ID NO: 3454 - DNA, 23 bp, Artificial
  gRNA target site sequence
cagacaggtatgggctgtccagg

SEQ ID NO: 3455 - DNA, 23 bp, Artificial
  gRNA target site sequence
agacaggtatgggctgtccaggg

SEQ ID NO: 3456 - DNA, 23 bp, Artificial
  gRNA target site sequence
tgcaagaggagggaagctcttgg

SEQ ID NO: 3457 - DNA, 23 bp, Artificial
  gRNA target site sequence
catacctgtctgcaagaggaggg

SEQ ID NO: 3458 - DNA, 23 bp, Artificial
  gRNA target site sequence
ccatacctgtctgcaagaggagg

SEQ ID NO: 3459 - DNA, 23 bp, Artificial
  gRNA target site sequence
agcccatacctgtctgcaagagg

SEQ ID NO: 3460 - DNA, 23 bp, Artificial
  gRNA target site sequence
tgtttattgtagatacttccagg

SEQ ID NO: 3461 - DNA, 23 bp, Artificial
  gRNA target site sequence
ttgtagatacttccaggctttgg

SEQ ID NO: 3462 - DNA, 23 bp, Artificial
  gRNA target site sequence
gccgctgcagcagaagttctagg

SEQ ID NO: 3463 - DNA, 23 bp, Artificial
  gRNA target site sequence
acttatacttcgatatgttatgg

SEQ ID NO: 3464 - DNA, 23 bp, Artificial
  gRNA target site sequence
acatattattcaccaaagcctgg

SEQ ID NO: 3465 - DNA, 23 bp, Artificial
  gRNA target site sequence
cacttctttatatcttacaaagg

SEQ ID NO: 3466 - DNA, 23 bp, Artificial
  gRNA target site sequence
tcctagaacttctgctgcagcgg

SEQ ID NO: 3467 - DNA, 23 bp, Artificial
  gRNA target site sequence
ctcctttgtgcttatgtttcagg

SEQ ID NO: 3468 - DNA, 23 bp, Artificial
  gRNA target site sequence
ttaatatttgaaaagttttccgg

SEQ ID NO: 3469 - DNA, 23 bp, Artificial
  gRNA target site sequence
aattctaaagacaactcagtagg

SEQ ID NO: 3470 - DNA, 23 bp, Artificial
  gRNA target site sequence
attctaaagacaactcagtaggg

SEQ ID NO: 3471 - DNA, 23 bp, Artificial
  gRNA target site sequence
tcagtagggattcaattgctagg

SEQ ID NO: 3472 - DNA, 23 bp, Artificial
  gRNA target site sequence
tcaattgctaggcatcgtgatgg

SEQ ID NO: 3473 - DNA, 23 bp, Artificial
  gRNA target site sequence
cctccctatgacccacagtgtgg

SEQ ID NO: 3474 - DNA, 23 bp, Artificial
  gRNA target site sequence
aacctgaaacataagcacaaagg

SEQ ID NO: 3475 - DNA, 23 bp, Artificial
  gRNA target site sequence
tttagaattaggatctttaccgg

SEQ ID NO: 3476 - DNA, 23 bp, Artificial
  gRNA target site sequence
actgagttgtctttagaattagg

SEQ ID NO: 3477 - DNA, 23 bp, Artificial
  gRNA target site sequence
gtcatagggaggcaggtcattgg

SEQ ID NO: 3478 - DNA, 23 bp, Artificial
  gRNA target site sequence
actgtgggtcatagggaggcagg

SEQ ID NO: 3479 - DNA, 23 bp, Artificial
  gRNA target site sequence
ccacactgtgggtcatagggagg

SEQ ID NO: 3480 - DNA, 23 bp, Artificial
  gRNA target site sequence
atgccacactgtgggtcataggg

SEQ ID NO: 3481 - DNA, 23 bp, Artificial
  gRNA target site sequence
gatgccacactgtgggtcatagg

SEQ ID NO: 3482 - DNA, 23 bp, Artificial
  gRNA target site sequence
tactctggatgccacactgtggg

SEQ ID NO: 3483 - DNA, 23 bp, Artificial
  gRNA target site sequence
ctactctggatgccacactgtgg

SEQ ID NO: 3484 - DNA, 23 bp, Artificial
  gRNA target site sequence
caaacacgtactcgctactctgg

SEQ ID NO: 3485 - DNA, 23 bp, Artificial
  gRNA target site sequence
cagaatttctgtaccttttcagg

SEQ ID NO: 3486 - DNA, 23 bp, Artificial
  gRNA target site sequence
agaatttctgtaccttttcaggg

SEQ ID NO: 3487 - DNA, 23 bp, Artificial
  gRNA target site sequence
gaatttctgtaccttttcagggg

SEQ ID NO: 3488 - DNA, 23 bp, Artificial
  gRNA target site sequence
aatttctgtaccttttcaggggg

SEQ ID NO: 3489 - DNA, 23 bp, Artificial
  gRNA target site sequence
taaagacccttgtcgagtgctgg

SEQ ID NO: 3490 - DNA, 23 bp, Artificial
  gRNA target site sequence
gacccttgtcgagtgctggaagg

SEQ ID NO: 3491 - DNA, 23 bp, Artificial
  gRNA target site sequence
attgtttatccatcccttatagg

SEQ ID NO: 3492 - DNA, 23 bp, Artificial
  gRNA target site sequence
tcccttataggtatgtttactgg

SEQ ID NO: 3493 - DNA, 23 bp, Artificial
  gRNA target site sequence
tctttagggaccccctgaaaagg

SEQ ID NO: 3494 - DNA, 23 bp, Artificial
  gRNA target site sequence
ttgctaacacttcatctttaggg

SEQ ID NO: 3495 - DNA, 23 bp, Artificial
  gRNA target site sequence
tttgctaacacttcatctttagg

SEQ ID NO: 3496 - DNA, 23 bp, Artificial
  gRNA target site sequence
gatgaaagacatgtttcattagg

SEQ ID NO: 3497 - DNA, 23 bp, Artificial
  gRNA target site sequence
tgtctaaacacagctctttttgg

SEQ ID NO: 3498 - DNA, 23 bp, Artificial
  gRNA target site sequence
caagggtctttataatttcaagg

SEQ ID NO: 3499 - DNA, 23 bp, Artificial
  gRNA target site sequence
atccttccagcactcgacaaggg

SEQ ID NO: 3500 - DNA, 23 bp, Artificial
  gRNA target site sequence
aatccttccagcactcgacaagg

SEQ ID NO: 3501 - DNA, 23 bp, Artificial
  gRNA target site sequence
gtaaacatacctataagggatgg

SEQ ID NO: 3502 - DNA, 23 bp, Artificial
  gRNA target site sequence
accagtaaacatacctataaggg

SEQ ID NO: 3503 - DNA, 23 bp, Artificial
  gRNA target site sequence
aaccagtaaacatacctataagg

SEQ ID NO: 3504 - DNA, 23 bp, Artificial
  gRNA target site sequence
tgacttttacatcctcttgtagg

SEQ ID NO: 3505 - DNA, 23 bp, Artificial
  gRNA target site sequence
ttcgcccttacgcgaagcactgg

SEQ ID NO: 3506 - DNA, 23 bp, Artificial
  gRNA target site sequence
gcttagccccttgctgcagctgg

SEQ ID NO: 3507 - DNA, 23 bp, Artificial
  gRNA target site sequence
ctggctgcttctgaaaacaatgg

SEQ ID NO: 3508 - DNA, 23 bp, Artificial
  gRNA target site sequence
gctgcttctgaaaacaatggagg

SEQ ID NO: 3509 - DNA, 23 bp, Artificial
  gRNA target site sequence
tctgaaaacaatggaggagaagg

SEQ ID NO: 3510 - DNA, 23 bp, Artificial
  gRNA target site sequence
aggagaaggaattcactacatgg

SEQ ID NO: 3511 - DNA, 23 bp, Artificial
  gRNA target site sequence
agaaggaattcactacatggtgg

SEQ ID NO: 3512 - DNA, 23 bp, Artificial
  gRNA target site sequence
ctacatggtggttgagatagtgg

SEQ ID NO: 3513 - DNA, 23 bp, Artificial
  gRNA target site sequence
tagtggccactattctttcatgg

SEQ ID NO: 3514 - DNA, 23 bp, Artificial
  gRNA target site sequence
gccactattctttcatggacagg

SEQ ID NO: 3515 - DNA, 23 bp, Artificial
  gRNA target site sequence
tattctttcatggacaggcttgg

SEQ ID NO: 3516 - DNA, 23 bp, Artificial
  gRNA target site sequence
gcttggccactccaacagtaagg

SEQ ID NO: 3517 - DNA, 23 bp, Artificial
  gRNA target site sequence
aagggcgaaagacctacaagagg

SEQ ID NO: 3518 - DNA, 23 bp, Artificial
  gRNA target site sequence
taagccagtgcttcgcgtaaggg

SEQ ID NO: 3519 - DNA, 23 bp, Artificial
  gRNA target site sequence
ctaagccagtgcttcgcgtaagg

SEQ ID NO: 3520 - DNA, 23 bp, Artificial
  gRNA target site sequence
aagcagccagctgcagcaagggg

SEQ ID NO: 3521 - DNA, 23 bp, Artificial
  gRNA target site sequence
gaagcagccagctgcagcaaggg

SEQ ID NO: 3522 - DNA, 23 bp, Artificial
  gRNA target site sequence
agaagcagccagctgcagcaagg

SEQ ID NO: 3523 - DNA, 23 bp, Artificial
  gRNA target site sequence
gcctgtccatgaaagaatagtgg

SEQ ID NO: 3524 - DNA, 23 bp, Artificial
  gRNA target site sequence
atcaatccttactgttggagtgg

SEQ ID NO: 3525 - DNA, 23 bp, Artificial
  gRNA target site sequence
gatgcatcaatccttactgttgg

SEQ ID NO: 3526 - DNA, 23 bp, Artificial
  gRNA target site sequence
aattttgaatgttttattttagg

SEQ ID NO: 3527 - DNA, 23 bp, Artificial
  gRNA target site sequence
tgccaagagatcttccttcttgg

SEQ ID NO: 3528 - DNA, 23 bp, Artificial
  gRNA target site sequence
tcttggatgaaattcctccatgg

SEQ ID NO: 3529 - DNA, 23 bp, Artificial
  gRNA target site sequence
gaaattcctccatggcaaactgg

SEQ ID NO: 3530 - DNA, 23 bp, Artificial
  gRNA target site sequence
aaattcctccatggcaaactggg

SEQ ID NO: 3531 - DNA, 23 bp, Artificial
  gRNA target site sequence
gcttgttattaatacagaagagg

SEQ ID NO: 3532 - DNA, 23 bp, Artificial
  gRNA target site sequence
atccaagaaggaagatctcttgg

SEQ ID NO: 3533 - DNA, 23 bp, Artificial
  gRNA target site sequence
tggaggaatttcatccaagaagg

SEQ ID NO: 3534 - DNA, 23 bp, Artificial
  gRNA target site sequence
gatttcccagtttgccatggagg

SEQ ID NO: 3535 - DNA, 23 bp, Artificial
  gRNA target site sequence
ttggatttcccagtttgccatgg

SEQ ID NO: 3536 - DNA, 23 bp, Artificial
  gRNA target site sequence
cggatatttaatggtactattgg

SEQ ID NO: 3537 - DNA, 23 bp, Artificial
  gRNA target site sequence
aagaagagacggatatttaatgg

SEQ ID NO: 3538 - DNA, 23 bp, Artificial
  gRNA target site sequence
caagcttggctaagaagagacgg

SEQ ID NO: 3539 - DNA, 23 bp, Artificial
  gRNA target site sequence
ttctgtattaataacaagcttgg

SEQ ID NO: 3540 - DNA, 23 bp, Artificial
  gRNA target site sequence
tcctgggccctccctttcgcagg

SEQ ID NO: 3541 - DNA, 23 bp, Artificial
  gRNA target site sequence
cctccctttcgcaggagcagcgg

SEQ ID NO: 3542 - DNA, 23 bp, Artificial
  gRNA target site sequence
ctccctttcgcaggagcagcggg

SEQ ID NO: 3543 - DNA, 23 bp, Artificial
  gRNA target site sequence
gcaggagcagcgggaccccacgg

SEQ ID NO: 3544 - DNA, 23 bp, Artificial
  gRNA target site sequence
cacggtgcatgatgatgtgctgg

SEQ ID NO: 3545 - DNA, 23 bp, Artificial
  gRNA target site sequence
gcatgatgatgtgctggagctgg

SEQ ID NO: 3546 - DNA, 23 bp, Artificial
  gRNA target site sequence
tgatgtgctggagctggagatgg

SEQ ID NO: 3547 - DNA, 23 bp, Artificial
  gRNA target site sequence
tggagatggacgagctcaatcgg

SEQ ID NO: 3548 - DNA, 23 bp, Artificial
  gRNA target site sequence
gctcaatcggcatgagtgcatgg

SEQ ID NO: 3549 - DNA, 23 bp, Artificial
  gRNA target site sequence
tgagtgcatggcgcccctgacgg

SEQ ID NO: 3550 - DNA, 23 bp, Artificial
  gRNA target site sequence
catggcgcccctgacggccctgg

SEQ ID NO: 3551 - DNA, 23 bp, Artificial
  gRNA target site sequence
caagcacatgcacagaagcctgg

SEQ ID NO: 3552 - DNA, 23 bp, Artificial
  gRNA target site sequence
aagcacatgcacagaagcctggg

SEQ ID NO: 3553 - DNA, 23 bp, Artificial
  gRNA target site sequence
agaagcctgggcccgcctcaagg

SEQ ID NO: 3554 - DNA, 23 bp, Artificial
  gRNA target site sequence
gggcccgcctcaaggagaagagg

SEQ ID NO: 3555 - DNA, 23 bp, Artificial
  gRNA target site sequence
tcctgcgaaagggagggcccagg

SEQ ID NO: 3556 - DNA, 23 bp, Artificial
  gRNA target site sequence
cgctgctcctgcgaaagggaggg

SEQ ID NO: 3557 - DNA, 23 bp, Artificial
  gRNA target site sequence
ccgctgctcctgcgaaagggagg

SEQ ID NO: 3558 - DNA, 23 bp, Artificial
  gRNA target site sequence
gtcccgctgctcctgcgaaaggg

SEQ ID NO: 3559 - DNA, 23 bp, Artificial
  gRNA target site sequence
ggtcccgctgctcctgcgaaagg

SEQ ID NO: 3560 - DNA, 23 bp, Artificial
  gRNA target site sequence
gcacatcatcatgcaccgtgggg

SEQ ID NO: 3561 - DNA, 23 bp, Artificial
  gRNA target site sequence
agcacatcatcatgcaccgtggg

SEQ ID NO: 3562 - DNA, 23 bp, Artificial
  gRNA target site sequence
cagcacatcatcatgcaccgtgg

SEQ ID NO: 3563 - DNA, 23 bp, Artificial
  gRNA target site sequence
tgcttgaccagggccgtcagggg

SEQ ID NO: 3564 - DNA, 23 bp, Artificial
  gRNA target site sequence
gtgcttgaccagggccgtcaggg

SEQ ID NO: 3565 - DNA, 23 bp, Artificial
  gRNA target site sequence
tgtgcttgaccagggccgtcagg

SEQ ID NO: 3566 - DNA, 23 bp, Artificial
  gRNA target site sequence
tctgtgcatgtgcttgaccaggg

SEQ ID NO: 3567 - DNA, 23 bp, Artificial
  gRNA target site sequence
ttctgtgcatgtgcttgaccagg

SEQ ID NO: 3568 - DNA, 23 bp, Artificial
  gRNA target site sequence
cttctccttgaggcgggcccagg

SEQ ID NO: 3569 - DNA, 23 bp, Artificial
  gRNA target site sequence
gcacctcttctccttgaggcggg

SEQ ID NO: 3570 - DNA, 23 bp, Artificial
  gRNA target site sequence
agcacctcttctccttgaggcgg

SEQ ID NO: 3571 - DNA, 23 bp, Artificial
  gRNA target site sequence
aaaagcacctcttctccttgagg

SEQ ID NO: 3572 - DNA, 23 bp, Artificial
  gRNA target site sequence
ctccttttttatatttcagatgg

SEQ ID NO: 3573 - DNA, 23 bp, Artificial
  gRNA target site sequence
tatgtcttccctgtcatatttgg

SEQ ID NO: 3574 - DNA, 23 bp, Artificial
  gRNA target site sequence
ggcagacagtaccctgagtgagg

SEQ ID NO: 3575 - DNA, 23 bp, Artificial
  gRNA target site sequence
agtcaatttgatttctcaaccgg

SEQ ID NO: 3576 - DNA, 23 bp, Artificial
  gRNA target site sequence
caagaccctagacctgccactgg

SEQ ID NO: 3577 - DNA, 23 bp, Artificial
  gRNA target site sequence
gacctgccactggtcgttttcgg

SEQ ID NO: 3578 - DNA, 23 bp, Artificial
  gRNA target site sequence
ccactggtcgttttcggagacgg

SEQ ID NO: 3579 - DNA, 23 bp, Artificial
  gRNA target site sequence
cactggtcgttttcggagacggg

SEQ ID NO: 3580 - DNA, 23 bp, Artificial
  gRNA target site sequence
gaccatctgaaatataaaaaagg

SEQ ID NO: 3581 - DNA, 23 bp, Artificial
  gRNA target site sequence
gacagggaagacatataggaagg

SEQ ID NO: 3582 - DNA, 23 bp, Artificial
  gRNA target site sequence
atatgacagggaagacatatagg

SEQ ID NO: 3583 - DNA, 23 bp, Artificial
  gRNA target site sequence
actgtctgccaaatatgacaggg

SEQ ID NO: 3584 - DNA, 23 bp, Artificial
  gRNA target site sequence
tactgtctgccaaatatgacagg

SEQ ID NO: 3585 - DNA, 23 bp, Artificial
  gRNA target site sequence
ttgactcatttcctcactcaggg

SEQ ID NO: 3586 - DNA, 23 bp, Artificial
  gRNA target site sequence
attgactcatttcctcactcagg

SEQ ID NO: 3587 - DNA, 23 bp, Artificial
  gRNA target site sequence
gtatgaatagctctgaactccgg

SEQ ID NO: 3588 - DNA, 23 bp, Artificial
  gRNA target site sequence
agtggcaggtctagggtcttggg

SEQ ID NO: 3589 - DNA, 23 bp, Artificial
  gRNA target site sequence
cagtggcaggtctagggtcttgg

SEQ ID NO: 3590 - DNA, 23 bp, Artificial
  gRNA target site sequence
aacgaccagtggcaggtctaggg

SEQ ID NO: 3591 - DNA, 23 bp, Artificial
  gRNA target site sequence
aaacgaccagtggcaggtctagg

SEQ ID NO: 3592 - DNA, 23 bp, Artificial
  gRNA target site sequence
ctccgaaaacgaccagtggcagg

SEQ ID NO: 3593 - DNA, 23 bp, Artificial
  gRNA target site sequence
ccgtctccgaaaacgaccagtgg

SEQ ID NO: 3594 - DNA, 23 bp, Artificial
  gRNA target site sequence
gtttatttgttcttcccaatagg

SEQ ID NO: 3595 - DNA, 23 bp, Artificial
  gRNA target site sequence
ttcttcccaataggttcctatgg

SEQ ID NO: 3596 - DNA, 23 bp, Artificial
  gRNA target site sequence
agaaaaagtacattgaaattagg

SEQ ID NO: 3597 - DNA, 23 bp, Artificial
  gRNA target site sequence
gaagccagagaagcagcaaatgg

SEQ ID NO: 3598 - DNA, 23 bp, Artificial
  gRNA target site sequence
aagccagagaagcagcaaatggg

SEQ ID NO: 3599 - DNA, 23 bp, Artificial
  gRNA target site sequence
agccagagaagcagcaaatgggg

SEQ ID NO: 3600 - DNA, 23 bp, Artificial
  gRNA target site sequence
gaagcagcaaatggggattcagg

SEQ ID NO: 3601 - DNA, 23 bp, Artificial
  gRNA target site sequence
cagcaaatggggattcaggtagg

SEQ ID NO: 3602 - DNA, 23 bp, Artificial
  gRNA target site sequence
tctttccataggaacctattggg

SEQ ID NO: 3603 - DNA, 23 bp, Artificial
  gRNA target site sequence
ttctttccataggaacctattgg

SEQ ID NO: 3604 - DNA, 23 bp, Artificial
  gRNA target site sequence
tactttttctttctttccatagg

SEQ ID NO: 3605 - DNA, 23 bp, Artificial
  gRNA target site sequence
atccccatttgctgcttctctgg

SEQ ID NO: 3606 - DNA, 23 bp, Artificial
  gRNA target site sequence
taattttcctgtagaagttgagg

SEQ ID NO: 3607 - DNA, 23 bp, Artificial
  gRNA target site sequence
gaaaattatagcggcgcttcagg

SEQ ID NO: 3608 - DNA, 23 bp, Artificial
  gRNA target site sequence
cttctacaggaaaattatagcgg

SEQ ID NO: 3609 - DNA, 23 bp, Artificial
  gRNA target site sequence
tcactcacctcaacttctacagg

SEQ ID NO: 3610 - DNA, 23 bp, Artificial
  gRNA target site sequence
cgatgcatttacagagaacatgg

SEQ ID NO: 3611 - DNA, 23 bp, Artificial
  gRNA target site sequence
gcatttacagagaacatggcagg

SEQ ID NO: 3612 - DNA, 23 bp, Artificial
  gRNA target site sequence
ggcaggagagaatcagctgctgg

SEQ ID NO: 3613 - DNA, 23 bp, Artificial
  gRNA target site sequence
gagagaatcagctgctggagagg

SEQ ID NO: 3614 - DNA, 23 bp, Artificial
  gRNA target site sequence
aatgagttaaaattttaccaagg

SEQ ID NO: 3615 - DNA, 23 bp, Artificial
  gRNA target site sequence
gtttagtgaaaaaccagaaaagg

SEQ ID NO: 3616 - DNA, 23 bp, Artificial
  gRNA target site sequence
agtgaaaaaccagaaaaggtagg

SEQ ID NO: 3617 - DNA, 23 bp, Artificial
  gRNA target site sequence
gaaaaggtaggccactcctacgg

SEQ ID NO: 3618 - DNA, 23 bp, Artificial
  gRNA target site sequence
cgcagttgtatgctgcacaatgg

SEQ ID NO: 3619 - DNA, 23 bp, Artificial
  gRNA target site sequence
gacacagcagatgacagatatgg

SEQ ID NO: 3620 - DNA, 23 bp, Artificial
  gRNA target site sequence
tttcactaaacagaaaaccttgg

SEQ ID NO: 3621 - DNA, 23 bp, Artificial
  gRNA target site sequence
taggagtggcctaccttttctgg

SEQ ID NO: 3622 - DNA, 23 bp, Artificial
  gRNA target site sequence
tactcaaatcaccaagaagatgg

SEQ ID NO: 3623 - DNA, 23 bp, Artificial
  gRNA target site sequence
actcaaatcaccaagaagatggg

SEQ ID NO: 3624 - DNA, 23 bp, Artificial
  gRNA target site sequence
caaagatgatgttcatgctaagg

SEQ ID NO: 3625 - DNA, 23 bp, Artificial
  gRNA target site sequence
aaaattaatcaagttttccatgg

SEQ ID NO: 3626 - DNA, 23 bp, Artificial
  gRNA target site sequence
catggctcgtgtattacagaagg

SEQ ID NO: 3627 - DNA, 23 bp, Artificial
  gRNA target site sequence
agtaagattttacttaattttgg

SEQ ID NO: 3628 - DNA, 23 bp, Artificial
  gRNA target site sequence
agattcatttagcttcaaaaagg

SEQ ID NO: 3629 - DNA, 23 bp, Artificial
  gRNA target site sequence
cttggtgatttgagtatcaaagg

SEQ ID NO: 3630 - DNA, 23 bp, Artificial
  gRNA target site sequence
cttatagtagcccatcttcttgg

SEQ ID NO: 3631 - DNA, 23 bp, Artificial
  gRNA target site sequence
catgaacatcatctttgggaagg

SEQ ID NO: 3632 - DNA, 23 bp, Artificial
  gRNA target site sequence
ttagcatgaacatcatctttggg

SEQ ID NO: 3633 - DNA, 23 bp, Artificial
  gRNA target site sequence
cttagcatgaacatcatctttgg

SEQ ID NO: 3634 - DNA, 23 bp, Artificial
  gRNA target site sequence
cttctgtaatacacgagccatgg

SEQ ID NO: 3635 - DNA, 23 bp, Artificial
  gRNA target site sequence
taattttatcttgttttcttagg

SEQ ID NO: 3636 - DNA, 23 bp, Artificial
  gRNA target site sequence
aattttatcttgttttcttaggg

SEQ ID NO: 3637 - DNA, 23 bp, Artificial
  gRNA target site sequence
attttatcttgttttcttagggg

SEQ ID NO: 3638 - DNA, 23 bp, Artificial
  gRNA target site sequence
ggttcatgtgtcacacaagtagg

SEQ ID NO: 3639 - DNA, 23 bp, Artificial
  gRNA target site sequence
tgtcacacaagtaggccttctgg

SEQ ID NO: 3640 - DNA, 23 bp, Artificial
  gRNA target site sequence
aaagcgtgtatgaaatgttcagg

SEQ ID NO: 3641 - DNA, 23 bp, Artificial
  gRNA target site sequence
cgtgtatgaaatgttcaggaagg

SEQ ID NO: 3642 - DNA, 23 bp, Artificial
  gRNA target site sequence
tttcacacgccagtcctttgtgg

SEQ ID NO: 3643 - DNA, 23 bp, Artificial
  gRNA target site sequence
gctccctcctcactctgctgtgg

SEQ ID NO: 3644 - DNA, 23 bp, Artificial
  gRNA target site sequence
tctgctgtggcactgtagcctgg

SEQ ID NO: 3645 - DNA, 23 bp, Artificial
  gRNA target site sequence
agaattcttcagcacaattgtgg

SEQ ID NO: 3646 - DNA, 23 bp, Artificial
  gRNA target site sequence
attcttcagcacaattgtggtgg

SEQ ID NO: 3647 - DNA, 23 bp, Artificial
  gRNA target site sequence
ccattgatgtgttgaagtccagg

SEQ ID NO: 3648 - DNA, 23 bp, Artificial
  gRNA target site sequence
gttgaagtccaggtttacaaagg

SEQ ID NO: 3649 - DNA, 23 bp, Artificial
  gRNA target site sequence
tttcatacacgctttccagaagg

SEQ ID NO: 3650 - DNA, 23 bp, Artificial
  gRNA target site sequence
ggcgtgtgaaacttaggcggggg

SEQ ID NO: 3651 - DNA, 23 bp, Artificial
  gRNA target site sequence
tggcgtgtgaaacttaggcgggg

SEQ ID NO: 3652 - DNA, 23 bp, Artificial
  gRNA target site sequence
ctggcgtgtgaaacttaggcggg

SEQ ID NO: 3653 - DNA, 23 bp, Artificial
  gRNA target site sequence
actggcgtgtgaaacttaggcgg

SEQ ID NO: 3654 - DNA, 23 bp, Artificial
  gRNA target site sequence
aggactggcgtgtgaaacttagg

SEQ ID NO: 3655 - DNA, 23 bp, Artificial
  gRNA target site sequence
gggagcggtccacaaaggactgg

SEQ ID NO: 3656 - DNA, 23 bp, Artificial
  gRNA target site sequence
gaggagggagcggtccacaaagg

SEQ ID NO: 3657 - DNA, 23 bp, Artificial
  gRNA target site sequence
acagcagagtgaggagggagcgg

SEQ ID NO: 3658 - DNA, 23 bp, Artificial
  gRNA target site sequence
gtgccacagcagagtgaggaggg

SEQ ID NO: 3659 - DNA, 23 bp, Artificial
  gRNA target site sequence
agtgccacagcagagtgaggagg

SEQ ID NO: 3660 - DNA, 23 bp, Artificial
  gRNA target site sequence
tacagtgccacagcagagtgagg

SEQ ID NO: 3661 - DNA, 23 bp, Artificial
  gRNA target site sequence
agaattctctcaaagcatccagg

SEQ ID NO: 3662 - DNA, 23 bp, Artificial
  gRNA target site sequence
cctggacttcaacacatcaatgg

SEQ ID NO: 3663 - DNA, 23 bp, Artificial
  gRNA target site sequence
gtatgatacctttgtaaacctgg

SEQ ID NO: 3664 - DNA, 23 bp, Artificial
  gRNA target site sequence
tttctagtttctagatgcattgg

SEQ ID NO: 3665 - DNA, 23 bp, Artificial
  gRNA target site sequence
atctcaaagccctatgttgttgg

SEQ ID NO: 3666 - DNA, 23 bp, Artificial
  gRNA target site sequence
tgatgacagaagttctttgtcgg

SEQ ID NO: 3667 - DNA, 23 bp, Artificial
  gRNA target site sequence
gatgacagaagttctttgtcggg

SEQ ID NO: 3668 - DNA, 23 bp, Artificial
  gRNA target site sequence
tcgggaacagcagcatgtcatgg

SEQ ID NO: 3669 - DNA, 23 bp, Artificial
  gRNA target site sequence
aattatttcaatccagtttcagg

SEQ ID NO: 3670 - DNA, 23 bp, Artificial
  gRNA target site sequence
tatttcaatccagtttcaggagg

SEQ ID NO: 3671 - DNA, 23 bp, Artificial
  gRNA target site sequence
gtttcaggaggattgccagaagg

SEQ ID NO: 3672 - DNA, 23 bp, Artificial
  gRNA target site sequence
tgccagaaggtaagtcattctgg

SEQ ID NO: 3673 - DNA, 23 bp, Artificial
  gRNA target site sequence
gaaggtaagtcattctggcctgg

SEQ ID NO: 3674 - DNA, 23 bp, Artificial
  gRNA target site sequence
aaggtaagtcattctggcctggg

SEQ ID NO: 3675 - DNA, 23 bp, Artificial
  gRNA target site sequence
tcatcaattccaacaacataggg

SEQ ID NO: 3676 - DNA, 23 bp, Artificial
  gRNA target site sequence
gtcatcaattccaacaacatagg

SEQ ID NO: 3677 - DNA, 23 bp, Artificial
  gRNA target site sequence
tctggcaatcctcctgaaactgg

SEQ ID NO: 3678 - DNA, 23 bp, Artificial
  gRNA target site sequence
ggccagaatgacttaccttctgg

SEQ ID NO: 3679 - DNA, 23 bp, Artificial
  gRNA target site sequence
ttatgtctgtcttgctccacagg

SEQ ID NO: 3680 - DNA, 23 bp, Artificial
  gRNA target site sequence
tatgtctgtcttgctccacaggg

SEQ ID NO: 3681 - DNA, 23 bp, Artificial
  gRNA target site sequence
ccattcttcaccagcctcactgg

SEQ ID NO: 3682 - DNA, 23 bp, Artificial
  gRNA target site sequence
ttcttcaccagcctcactggagg

SEQ ID NO: 3683 - DNA, 23 bp, Artificial
  gRNA target site sequence
cagcctcactggaggcagtctgg

SEQ ID NO: 3684 - DNA, 23 bp, Artificial
  gRNA target site sequence
cctcactggaggcagtctggagg

SEQ ID NO: 3685 - DNA, 23 bp, Artificial
  gRNA target site sequence
ggaggaacttagacgtgttctgg

SEQ ID NO: 3686 - DNA, 23 bp, Artificial
  gRNA target site sequence
ctcacttccccatgcagtccagg

SEQ ID NO: 3687 - DNA, 23 bp, Artificial
  gRNA target site sequence
tcacttccccatgcagtccaggg

SEQ ID NO: 3688 - DNA, 23 bp, Artificial
  gRNA target site sequence
cagtccagggaatttcctccagg

SEQ ID NO: 3689 - DNA, 23 bp, Artificial
  gRNA target site sequence
aatttcctccaggaactccgcgg

SEQ ID NO: 3690 - DNA, 23 bp, Artificial
  gRNA target site sequence
tccgcggttcaataattatgtgg

SEQ ID NO: 3691 - DNA, 23 bp, Artificial
  gRNA target site sequence
ttatgtggactgcatgaaaaagg

SEQ ID NO: 3692 - DNA, 23 bp, Artificial
  gRNA target site sequence
agagtgacagcttggccctgtgg

SEQ ID NO: 3693 - DNA, 23 bp, Artificial
  gRNA target site sequence
atggaagaagagtgacagcttgg

SEQ ID NO: 3694 - DNA, 23 bp, Artificial
  gRNA target site sequence
ccagtgaggctggtgaagaatgg

SEQ ID NO: 3695 - DNA, 23 bp, Artificial
  gRNA target site sequence
cagactgcctccagtgaggctgg

SEQ ID NO: 3696 - DNA, 23 bp, Artificial
  gRNA target site sequence
cctccagactgcctccagtgagg

SEQ ID NO: 3697 - DNA, 23 bp, Artificial
  gRNA target site sequence
gaaattccctggactgcatgggg

SEQ ID NO: 3698 - DNA, 23 bp, Artificial
  gRNA target site sequence
ggaaattccctggactgcatggg

SEQ ID NO: 3699 - DNA, 23 bp, Artificial
  gRNA target site sequence
aggaaattccctggactgcatgg

SEQ ID NO: 3700 - DNA, 23 bp, Artificial
  gRNA target site sequence
agttcctggaggaaattccctgg

SEQ ID NO: 3701 - DNA, 23 bp, Artificial
  gRNA target site sequence
ttgaaccgcggagttcctggagg

SEQ ID NO: 3702 - DNA, 23 bp, Artificial
  gRNA target site sequence
ttattgaaccgcggagttcctgg

SEQ ID NO: 3703 - DNA, 23 bp, Artificial
  gRNA target site sequence
tccacataattattgaaccgcgg

SEQ ID NO: 3704 - DNA, 23 bp, Artificial
  gRNA target site sequence
gtatcttttaatacaagtcatgg

SEQ ID NO: 3705 - DNA, 23 bp, Artificial
  gRNA target site sequence
tctacttgctgacacaaagctgg

SEQ ID NO: 3706 - DNA, 23 bp, Artificial
  gRNA target site sequence
aaagctggatctacatttaaagg

SEQ ID NO: 3707 - DNA, 23 bp, Artificial
  gRNA target site sequence
aaaggaaggaaaagaaaaacagg

SEQ ID NO: 3708 - DNA, 23 bp, Artificial
  gRNA target site sequence
agatgaatcaatctaaaggaagg

SEQ ID NO: 3709 - DNA, 23 bp, Artificial
  gRNA target site sequence
atacagatgaatcaatctaaagg

SEQ ID NO: 3710 - DNA, 23 bp, Artificial
  gRNA target site sequence
tatatgttgtaaagacttcaggg

SEQ ID NO: 3711 - DNA, 23 bp, Artificial
  gRNA target site sequence
atatatgttgtaaagacttcagg

SEQ ID NO: 3712 - DNA, 23 bp, Artificial
  gRNA target site sequence
actcacaacgaaattgtctcagg

SEQ ID NO: 3713 - DNA, 23 bp, Artificial
  gRNA target site sequence
caggtgagtgccgttttgaacgg

SEQ ID NO: 3714 - DNA, 23 bp, Artificial
  gRNA target site sequence
gcatgttagaccagagcttcagg

SEQ ID NO: 3715 - DNA, 23 bp, Artificial
  gRNA target site sequence
catgttagaccagagcttcaggg

SEQ ID NO: 3716 - DNA, 23 bp, Artificial
  gRNA target site sequence
cgagcaaaccagaaacaccaagg

SEQ ID NO: 3717 - DNA, 23 bp, Artificial
  gRNA target site sequence
cgactacaattctgcaacactgg

SEQ ID NO: 3718 - DNA, 23 bp, Artificial
  gRNA target site sequence
actggaagaagtgtgattcatgg

SEQ ID NO: 3719 - DNA, 23 bp, Artificial
  gRNA target site sequence
ggaagaagtgtgattcatggtgg

SEQ ID NO: 3720 - DNA, 23 bp, Artificial
  gRNA target site sequence
gaagaagtgtgattcatggtggg

SEQ ID NO: 3721 - DNA, 23 bp, Artificial
  gRNA target site sequence
ttcccctctcgaaactaaaatgg

SEQ ID NO: 3722 - DNA, 23 bp, Artificial
  gRNA target site sequence
cgaaactaaaatggcagtgctgg

SEQ ID NO: 3723 - DNA, 23 bp, Artificial
  gRNA target site sequence
aatggcagtgctggccttactgg

SEQ ID NO: 3724 - DNA, 23 bp, Artificial
  gRNA target site sequence
cttactggcaaaaattttacagg

SEQ ID NO: 3725 - DNA, 23 bp, Artificial
  gRNA target site sequence
gtctaacatgccgttcaaaacgg

SEQ ID NO: 3726 - DNA, 23 bp, Artificial
  gRNA target site sequence
ttgctcgctccctgaagctctgg

SEQ ID NO: 3727 - DNA, 23 bp, Artificial
  gRNA target site sequence
gtttcagtccttggtgtttctgg

SEQ ID NO: 3728 - DNA, 23 bp, Artificial
  gRNA target site sequence
tagtcgcaagtttcagtccttgg

SEQ ID NO: 3729 - DNA, 23 bp, Artificial
  gRNA target site sequence
agtttcgagaggggaatctttgg

SEQ ID NO: 3730 - DNA, 23 bp, Artificial
  gRNA target site sequence
tgccattttagtttcgagagggg

SEQ ID NO: 3731 - DNA, 23 bp, Artificial
  gRNA target site sequence
ctgccattttagtttcgagaggg

SEQ ID NO: 3732 - DNA, 23 bp, Artificial
  gRNA target site sequence
actgccattttagtttcgagagg

SEQ ID NO: 3733 - DNA, 23 bp, Artificial
  gRNA target site sequence
ctgtaaaatttttgccagtaagg

SEQ ID NO: 3734 - DNA, 23 bp, Artificial
  gRNA target site sequence
gagtcttctcctgaacccagcgg

SEQ ID NO: 3735 - DNA, 23 bp, Artificial
  gRNA target site sequence
gaacccagcggtgctgtccacgg

SEQ ID NO: 3736 - DNA, 23 bp, Artificial
  gRNA target site sequence
ggtgctgtccacggcgtccttgg

SEQ ID NO: 3737 - DNA, 23 bp, Artificial
  gRNA target site sequence
gtgctgtccacggcgtccttggg

SEQ ID NO: 3738 - DNA, 23 bp, Artificial
  gRNA target site sequence
ggcgtccttgggcagctcacagg

SEQ ID NO: 3739 - DNA, 23 bp, Artificial
  gRNA target site sequence
gcgtccttgggcagctcacaggg

SEQ ID NO: 3740 - DNA, 23 bp, Artificial
  gRNA target site sequence
agcgtcatccacttctcccatgg

SEQ ID NO: 3741 - DNA, 23 bp, Artificial
  gRNA target site sequence
gcgtcatccacttctcccatggg

SEQ ID NO: 3742 - DNA, 23 bp, Artificial
  gRNA target site sequence
cgtcatccacttctcccatgggg

SEQ ID NO: 3743 - DNA, 23 bp, Artificial
  gRNA target site sequence
gttctcagaaacgatcaacacgg

SEQ ID NO: 3744 - DNA, 23 bp, Artificial
  gRNA target site sequence
cacggaattattgaaaaatctgg

SEQ ID NO: 3745 - DNA, 23 bp, Artificial
  gRNA target site sequence
aaatctggatcttgctgtattgg

SEQ ID NO: 3746 - DNA, 23 bp, Artificial
  gRNA target site sequence
ggagctcatgcagtcttcagtgg

SEQ ID NO: 3747 - DNA, 23 bp, Artificial
  gRNA target site sequence
ttcagtggataataccaaaatgg

SEQ ID NO: 3748 - DNA, 23 bp, Artificial
  gRNA target site sequence
gctcacactgggaaaaagaaagg

SEQ ID NO: 3749 - DNA, 23 bp, Artificial
  gRNA target site sequence
actcacaaggcgctcacactggg

SEQ ID NO: 3750 - DNA, 23 bp, Artificial
  gRNA target site sequence
gactcacaaggcgctcacactgg

SEQ ID NO: 3751 - DNA, 23 bp, Artificial
  gRNA target site sequence
ggttcaggagaagactcacaagg

SEQ ID NO: 3752 - DNA, 23 bp, Artificial
  gRNA target site sequence
tggacagcaccgctgggttcagg

SEQ ID NO: 3753 - DNA, 23 bp, Artificial
  gRNA target site sequence
acgccgtggacagcaccgctggg

SEQ ID NO: 3754 - DNA, 23 bp, Artificial
  gRNA target site sequence
gacgccgtggacagcaccgctgg

SEQ ID NO: 3755 - DNA, 23 bp, Artificial
  gRNA target site sequence
tgagctgcccaaggacgccgtgg

SEQ ID NO: 3756 - DNA, 23 bp, Artificial
  gRNA target site sequence
gctgccctgtgagctgcccaagg

SEQ ID NO: 3757 - DNA, 23 bp, Artificial
  gRNA target site sequence
aatactccccatgggagaagtgg

SEQ ID NO: 3758 - DNA, 23 bp, Artificial
  gRNA target site sequence
gctatagaaatactccccatggg

SEQ ID NO: 3759 - DNA, 23 bp, Artificial
  gRNA target site sequence
agctatagaaatactccccatgg

SEQ ID NO: 3760 - DNA, 23 bp, Artificial
  gRNA target site sequence
gggaaactttgttaccattttgg

SEQ ID NO: 3761 - DNA, 23 bp, Artificial
  gRNA target site sequence
acagatttgcatcattctgttgg

SEQ ID NO: 3762 - DNA, 23 bp, Artificial
  gRNA target site sequence
tggcacagaacttctttccctgg

SEQ ID NO: 3763 - DNA, 23 bp, Artificial
  gRNA target site sequence
cttctttccctggtttataaagg

SEQ ID NO: 3764 - DNA, 23 bp, Artificial
  gRNA target site sequence
gtttataaaggcattgcccctgg

SEQ ID NO: 3765 - DNA, 23 bp, Artificial
  gRNA target site sequence
agacctcagttgtaagcagctgg

SEQ ID NO: 3766 - DNA, 23 bp, Artificial
  gRNA target site sequence
agttgtaagcagctggccagcgg

SEQ ID NO: 3767 - DNA, 23 bp, Artificial
  gRNA target site sequence
gcagctggccagcggacttctgg

SEQ ID NO: 3768 - DNA, 23 bp, Artificial
  gRNA target site sequence
ctggagttagcctttgcttttgg

SEQ ID NO: 3769 - DNA, 23 bp, Artificial
  gRNA target site sequence
gagttagcctttgcttttggagg

SEQ ID NO: 3770 - DNA, 23 bp, Artificial
  gRNA target site sequence
agcctttgcttttggaggactgg

SEQ ID NO: 3771 - DNA, 23 bp, Artificial
  gRNA target site sequence
tttgcttttggaggactggtagg

SEQ ID NO: 3772 - DNA, 23 bp, Artificial
  gRNA target site sequence
atgcaaatctgtggactaaaagg

SEQ ID NO: 3773 - DNA, 23 bp, Artificial
  gRNA target site sequence
aacagaatgatgcaaatctgtgg

SEQ ID NO: 3774 - DNA, 23 bp, Artificial
  gRNA target site sequence
ggcaatgcctttataaaccaggg

SEQ ID NO: 3775 - DNA, 23 bp, Artificial
  gRNA target site sequence
gggcaatgcctttataaaccagg

SEQ ID NO: 3776 - DNA, 23 bp, Artificial
  gRNA target site sequence
acactgtctctcatctccagggg

SEQ ID NO: 3777 - DNA, 23 bp, Artificial
  gRNA target site sequence
gacactgtctctcatctccaggg

SEQ ID NO: 3778 - DNA, 23 bp, Artificial
  gRNA target site sequence
agacactgtctctcatctccagg

SEQ ID NO: 3779 - DNA, 23 bp, Artificial
  gRNA target site sequence
ttacaactgaggtctagagaagg

SEQ ID NO: 3780 - DNA, 23 bp, Artificial
  gRNA target site sequence
tggccagctgcttacaactgagg

SEQ ID NO: 3781 - DNA, 23 bp, Artificial
  gRNA target site sequence
ggctaactccagaagtccgctgg

SEQ ID NO: 3782 - DNA, 23 bp, Artificial
  gRNA target site sequence
taccagtcctccaaaagcaaagg

SEQ ID NO: 3783 - DNA, 23 bp, Artificial
  gRNA target site sequence
ttgtcacatggccagcattgagg

SEQ ID NO: 3784 - DNA, 23 bp, Artificial
  gRNA target site sequence
ctttgtgccgtcaacttgtatgg

SEQ ID NO: 3785 - DNA, 23 bp, Artificial
  gRNA target site sequence
gtatggccctgacgcgcaagtgg

SEQ ID NO: 3786 - DNA, 23 bp, Artificial
  gRNA target site sequence
gccctgacgcgcaagtggacagg

SEQ ID NO: 3787 - DNA, 23 bp, Artificial
  gRNA target site sequence
acgcgcaagtggacaggagcagg

SEQ ID NO: 3788 - DNA, 23 bp, Artificial
  gRNA target site sequence
gcaagtggacaggagcaggctgg

SEQ ID NO: 3789 - DNA, 23 bp, Artificial
  gRNA target site sequence
tgtaaacagcttcacagagctgg

SEQ ID NO: 3790 - DNA, 23 bp, Artificial
  gRNA target site sequence
gtaaacagcttcacagagctggg

SEQ ID NO: 3791 - DNA, 23 bp, Artificial
  gRNA target site sequence
gcataatatattaccgtctcagg

SEQ ID NO: 3792 - DNA, 23 bp, Artificial
  gRNA target site sequence
ggcacaaagctcctcaatgctgg

SEQ ID NO: 3793 - DNA, 23 bp, Artificial
  gRNA target site sequence
gtcagggccatacaagttgacgg

SEQ ID NO: 3794 - DNA, 23 bp, Artificial
  gRNA target site sequence
tcctgtccacttgcgcgtcaggg

SEQ ID NO: 3795 - DNA, 23 bp, Artificial
  gRNA target site sequence
ctcctgtccacttgcgcgtcagg

SEQ ID NO: 3796 - DNA, 23 bp, Artificial
  gRNA target site sequence
agctctgtgaagctgtttacagg

SEQ ID NO: 3797 - DNA, 23 bp, Artificial
  gRNA target site sequence
taagttatagttacctgagacgg

SEQ ID NO: 3798 - DNA, 23 bp, Artificial
  gRNA target site sequence
tctgttacagctcctgaagaagg

SEQ ID NO: 3799 - DNA, 23 bp, Artificial
  gRNA target site sequence
tacacacctgatgagagtcctgg

SEQ ID NO: 3800 - DNA, 23 bp, Artificial
  gRNA target site sequence
ctgtgtgagcccgcaagcatagg

SEQ ID NO: 3801 - DNA, 23 bp, Artificial
  gRNA target site sequence
gcaagcataggtttcaacatcgg

SEQ ID NO: 3802 - DNA, 23 bp, Artificial
  gRNA target site sequence
tttcaacatcggagacgtccagg

SEQ ID NO: 3803 - DNA, 23 bp, Artificial
  gRNA target site sequence
catcggagacgtccaggttatgg

SEQ ID NO: 3804 - DNA, 23 bp, Artificial
  gRNA target site sequence
gagagaaaataacagcacagagg

SEQ ID NO: 3805 - DNA, 23 bp, Artificial
  gRNA target site sequence
agaaaataacagcacagaggtgg

SEQ ID NO: 3806 - DNA, 23 bp, Artificial
  gRNA target site sequence
gaaaataacagcacagaggtggg

SEQ ID NO: 3807 - DNA, 23 bp, Artificial
  gRNA target site sequence
acagcacagaggtgggtacttgg

SEQ ID NO: 3808 - DNA, 23 bp, Artificial
  gRNA target site sequence
cagcacagaggtgggtacttggg

SEQ ID NO: 3809 - DNA, 23 bp, Artificial
  gRNA target site sequence
gtgggtacttgggtcacaatcgg

SEQ ID NO: 3810 - DNA, 23 bp, Artificial
  gRNA target site sequence
tgggtacttgggtcacaatcggg

SEQ ID NO: 3811 - DNA, 23 bp, Artificial
  gRNA target site sequence
gggtacttgggtcacaatcgggg

SEQ ID NO: 3812 - DNA, 23 bp, Artificial
  gRNA target site sequence
tattacacaagtccttcttcagg

SEQ ID NO: 3813 - DNA, 23 bp, Artificial
  gRNA target site sequence
tctgcaccaggactctcatcagg

SEQ ID NO: 3814 - DNA, 23 bp, Artificial
  gRNA target site sequence
gctcacacagcgtctgcaccagg

SEQ ID NO: 3815 - DNA, 23 bp, Artificial
  gRNA target site sequence
atgttgaaacctatgcttgcggg

SEQ ID NO: 3816 - DNA, 23 bp, Artificial
  gRNA target site sequence
gatgttgaaacctatgcttgcgg

SEQ ID NO: 3817 - DNA, 23 bp, Artificial
  gRNA target site sequence
caggaagatgagccataacctgg

SEQ ID NO: 3818 - DNA, 23 bp, Artificial
  gRNA target site sequence
atcagattcacacaaacatcagg

SEQ ID NO: 3819 - DNA, 23 bp, Artificial
  gRNA target site sequence
ctctaggatatctttgtatgggg

SEQ ID NO: 3820 - DNA, 23 bp, Artificial
  gRNA target site sequence
tctctaggatatctttgtatggg

SEQ ID NO: 3821 - DNA, 23 bp, Artificial
  gRNA target site sequence
gtctctaggatatctttgtatgg

SEQ ID NO: 3822 - DNA, 23 bp, Artificial
  gRNA target site sequence
tctctctcagatgggtctctagg

SEQ ID NO: 3823 - DNA, 23 bp, Artificial
  gRNA target site sequence
tgttattttctctctcagatggg

SEQ ID NO: 3824 - DNA, 23 bp, Artificial
  gRNA target site sequence
ctgttattttctctctcagatgg

SEQ ID NO: 3825 - DNA, 23 bp, Artificial
  gRNA target site sequence
actttaatataattgcttctagg

SEQ ID NO: 3826 - DNA, 23 bp, Artificial
  gRNA target site sequence
gtcttcacttttgaaagcagtgg

SEQ ID NO: 3827 - DNA, 23 bp, Artificial
  gRNA target site sequence
atagcagcagaaaagtgctttgg

SEQ ID NO: 3828 - DNA, 23 bp, Artificial
  gRNA target site sequence
gcagaaaagtgctttggcactgg

SEQ ID NO: 3829 - DNA, 23 bp, Artificial
  gRNA target site sequence
cagaaaagtgctttggcactggg

SEQ ID NO: 3830 - DNA, 23 bp, Artificial
  gRNA target site sequence
agaaaagtgctttggcactgggg

SEQ ID NO: 3831 - DNA, 23 bp, Artificial
  gRNA target site sequence
tgctttggcactggggcagcagg

SEQ ID NO: 3832 - DNA, 23 bp, Artificial
  gRNA target site sequence
taacagaacaagcccacaagagg

SEQ ID NO: 3833 - DNA, 23 bp, Artificial
  gRNA target site sequence
aacagaacaagcccacaagaggg

SEQ ID NO: 3834 - DNA, 23 bp, Artificial
  gRNA target site sequence
caagcccacaagagggagaaagg

SEQ ID NO: 3835 - DNA, 23 bp, Artificial
  gRNA target site sequence
ctacagcaaatgcaccgttgtgg

SEQ ID NO: 3836 - DNA, 23 bp, Artificial
  gRNA target site sequence
gcaaatgcaccgttgtggtccgg

SEQ ID NO: 3837 - DNA, 23 bp, Artificial
  gRNA target site sequence
caccgttgtggtccggattatgg

SEQ ID NO: 3838 - DNA, 23 bp, Artificial
  gRNA target site sequence
gactctgctaaacacctccccgg

SEQ ID NO: 3839 - DNA, 23 bp, Artificial
  gRNA target site sequence
ctgctaaacacctccccggaagg

SEQ ID NO: 3840 - DNA, 23 bp, Artificial
  gRNA target site sequence
taaacacctccccggaaggatgg

SEQ ID NO: 3841 - DNA, 23 bp, Artificial
  gRNA target site sequence
cacctccccggaaggatggaagg

SEQ ID NO: 3842 - DNA, 23 bp, Artificial
  gRNA target site sequence
tccccggaaggatggaaggtagg

SEQ ID NO: 3843 - DNA, 23 bp, Artificial
  gRNA target site sequence
taggctgctctgttaatttgagg

SEQ ID NO: 3844 - DNA, 23 bp, Artificial
  gRNA target site sequence
tgctttcaaaagtgaagactggg

SEQ ID NO: 3845 - DNA, 23 bp, Artificial
  gRNA target site sequence
ctgctttcaaaagtgaagactgg

SEQ ID NO: 3846 - DNA, 23 bp, Artificial
  gRNA target site sequence
tgctgctataatgtcatgcatgg

SEQ ID NO: 3847 - DNA, 23 bp, Artificial
  gRNA target site sequence
tgtacctttctccctcttgtggg

SEQ ID NO: 3848 - DNA, 23 bp, Artificial
  gRNA target site sequence
ttgtacctttctccctcttgtgg

SEQ ID NO: 3849 - DNA, 23 bp, Artificial
  gRNA target site sequence
ctccataatccggaccacaacgg

SEQ ID NO: 3850 - DNA, 23 bp, Artificial
  gRNA target site sequence
tcgtggtaaactccataatccgg

SEQ ID NO: 3851 - DNA, 23 bp, Artificial
  gRNA target site sequence
ggaggtgtttagcagagtcgtgg

SEQ ID NO: 3852 - DNA, 23 bp, Artificial
  gRNA target site sequence
taccttccatccttccggggagg

SEQ ID NO: 3853 - DNA, 23 bp, Artificial
  gRNA target site sequence
gcctaccttccatccttccgggg

SEQ ID NO: 3854 - DNA, 23 bp, Artificial
  gRNA target site sequence
agcctaccttccatccttccggg

SEQ ID NO: 3855 - DNA, 23 bp, Artificial
  gRNA target site sequence
cagcctaccttccatccttccgg

SEQ ID NO: 3856 - DNA, 23 bp, Artificial
  gRNA target site sequence
ttaattttgtttctttttaaagg

SEQ ID NO: 3857 - DNA, 23 bp, Artificial
  gRNA target site sequence
gcaacagatcccctaatttgtgg

SEQ ID NO: 3858 - DNA, 23 bp, Artificial
  gRNA target site sequence
gtggctgaaagatgttctcaagg

SEQ ID NO: 3859 - DNA, 23 bp, Artificial
  gRNA target site sequence
aaagatgttctcaaggaagaagg

SEQ ID NO: 3860 - DNA, 23 bp, Artificial
  gRNA target site sequence
ttttctcatcaacacctttgagg

SEQ ID NO: 3861 - DNA, 23 bp, Artificial
  gRNA target site sequence
tttctcatcaacacctttgaggg

SEQ ID NO: 3862 - DNA, 23 bp, Artificial
  gRNA target site sequence
ttctcatcaacacctttgagggg

SEQ ID NO: 3863 - DNA, 23 bp, Artificial
  gRNA target site sequence
tctcatcaacacctttgaggggg

SEQ ID NO: 3864 - DNA, 23 bp, Artificial
  gRNA target site sequence
ctcatcaacacctttgagggggg

SEQ ID NO: 3865 - DNA, 23 bp, Artificial
  gRNA target site sequence
atcaacacctttgaggggggtgg

SEQ ID NO: 3866 - DNA, 23 bp, Artificial
  gRNA target site sequence
acctttgaggggggtggctgtgg

SEQ ID NO: 3867 - DNA, 23 bp, Artificial
  gRNA target site sequence
gggtggctgtggccagccctcgg

SEQ ID NO: 3868 - DNA, 23 bp, Artificial
  gRNA target site sequence
ggtggctgtggccagccctcggg

SEQ ID NO: 3869 - DNA, 23 bp, Artificial
  gRNA target site sequence
tggccagccctcgggcatcctgg

SEQ ID NO: 3870 - DNA, 23 bp, Artificial
  gRNA target site sequence
cagcccaccctcttgtacttcgg

SEQ ID NO: 3871 - DNA, 23 bp, Artificial
  gRNA target site sequence
agcccaccctcttgtacttcggg

SEQ ID NO: 3872 - DNA, 23 bp, Artificial
  gRNA target site sequence
gcccaccctcttgtacttcgggg

SEQ ID NO: 3873 - DNA, 23 bp, Artificial
  gRNA target site sequence
cccaccctcttgtacttcggggg

SEQ ID NO: 3874 - DNA, 23 bp, Artificial
  gRNA target site sequence
tcgggggccattcagcctgcagg

SEQ ID NO: 3875 - DNA, 23 bp, Artificial
  gRNA target site sequence
gcctgcaggccacgctatgctgg

SEQ ID NO: 3876 - DNA, 23 bp, Artificial
  gRNA target site sequence
gcaggccacgctatgctggctgg

SEQ ID NO: 3877 - DNA, 23 bp, Artificial
  gRNA target site sequence
atgctggctggacctgctcctgg

SEQ ID NO: 3878 - DNA, 23 bp, Artificial
  gRNA target site sequence
ggacctgctcctggccgcgttgg

SEQ ID NO: 3879 - DNA, 23 bp, Artificial
  gRNA target site sequence
gagtgctacaacacgttcattgg

SEQ ID NO: 3880 - DNA, 23 bp, Artificial
  gRNA target site sequence
ttcattggcgagagaactgtagg

SEQ ID NO: 3881 - DNA, 23 bp, Artificial
  gRNA target site sequence
gagaactgtaggagcgctccagg

SEQ ID NO: 3882 - DNA, 23 bp, Artificial
  gRNA target site sequence
gtaggagcgctccaggtcctagg

SEQ ID NO: 3883 - DNA, 23 bp, Artificial
  gRNA target site sequence
gagcgctccaggtcctaggtagg

SEQ ID NO: 3884 - DNA, 23 bp, Artificial
  gRNA target site sequence
aggtcacccttgccttattctgg

SEQ ID NO: 3885 - DNA, 23 bp, Artificial
  gRNA target site sequence
atctttcagccacaaattagggg

SEQ ID NO: 3886 - DNA, 23 bp, Artificial
  gRNA target site sequence
catctttcagccacaaattaggg

SEQ ID NO: 3887 - DNA, 23 bp, Artificial
  gRNA target site sequence
acatctttcagccacaaattagg

SEQ ID NO: 3888 - DNA, 23 bp, Artificial
  gRNA target site sequence
gccacagccacccccctcaaagg

SEQ ID NO: 3889 - DNA, 23 bp, Artificial
  gRNA target site sequence
gggccaggatgcccgagggctgg

SEQ ID NO: 3890 - DNA, 23 bp, Artificial
  gRNA target site sequence
ggctgggccaggatgcccgaggg

SEQ ID NO: 3891 - DNA, 23 bp, Artificial
  gRNA target site sequence
gggctgggccaggatgcccgagg

SEQ ID NO: 3892 - DNA, 23 bp, Artificial
  gRNA target site sequence
acaagagggtgggctgggccagg

SEQ ID NO: 3893 - DNA, 23 bp, Artificial
  gRNA target site sequence
gaagtacaagagggtgggctggg

SEQ ID NO: 3894 - DNA, 23 bp, Artificial
  gRNA target site sequence
cgaagtacaagagggtgggctgg

SEQ ID NO: 3895 - DNA, 23 bp, Artificial
  gRNA target site sequence
cccccgaagtacaagagggtggg

SEQ ID NO: 3896 - DNA, 23 bp, Artificial
  gRNA target site sequence
gcccccgaagtacaagagggtgg

SEQ ID NO: 3897 - DNA, 23 bp, Artificial
  gRNA target site sequence
atggcccccgaagtacaagaggg

SEQ ID NO: 3898 - DNA, 23 bp, Artificial
  gRNA target site sequence
aatggcccccgaagtacaagagg

SEQ ID NO: 3899 - DNA, 23 bp, Artificial
  gRNA target site sequence
agcgtggcctgcaggctgaatgg

SEQ ID NO: 3900 - DNA, 23 bp, Artificial
  gRNA target site sequence
gccagcatagcgtggcctgcagg

SEQ ID NO: 3901 - DNA, 23 bp, Artificial
  gRNA target site sequence
caggtccagccagcatagcgtgg

SEQ ID NO: 3902 - DNA, 23 bp, Artificial
  gRNA target site sequence
actccaacgcggccaggagcagg

SEQ ID NO: 3903 - DNA, 23 bp, Artificial
  gRNA target site sequence
tgtagcactccaacgcggccagg

SEQ ID NO: 3904 - DNA, 23 bp, Artificial
  gRNA target site sequence
cgtgttgtagcactccaacgcgg

SEQ ID NO: 3905 - DNA, 23 bp, Artificial
  gRNA target site sequence
agggtgacctacctaggacctgg

SEQ ID NO: 3906 - DNA, 23 bp, Artificial
  gRNA target site sequence
aaggcaagggtgacctacctagg

SEQ ID NO: 3907 - DNA, 23 bp, Artificial
  gRNA target site sequence
agtatgctgtctctgtgcagagg

SEQ ID NO: 3908 - DNA, 23 bp, Artificial
  gRNA target site sequence
ttccgcatcattgtgtttattgg

SEQ ID NO: 3909 - DNA, 23 bp, Artificial
  gRNA target site sequence
atcattgtgtttattggatctgg

SEQ ID NO: 3910 - DNA, 23 bp, Artificial
  gRNA target site sequence
gtttattggatctggtcaagtgg

SEQ ID NO: 3911 - DNA, 23 bp, Artificial
  gRNA target site sequence
aagtggcttttagctcattgtgg

SEQ ID NO: 3912 - DNA, 23 bp, Artificial
  gRNA target site sequence
agtggcttttagctcattgtggg

SEQ ID NO: 3913 - DNA, 23 bp, Artificial
  gRNA target site sequence
ggcttttagctcattgtgggagg

SEQ ID NO: 3914 - DNA, 23 bp, Artificial
  gRNA target site sequence
aaattcgttcctttattgccagg

SEQ ID NO: 3915 - DNA, 23 bp, Artificial
  gRNA target site sequence
cgttcctttattgccaggtatgg

SEQ ID NO: 3916 - DNA, 23 bp, Artificial
  gRNA target site sequence
aaacacaatgatgcggaaggtgg

SEQ ID NO: 3917 - DNA, 23 bp, Artificial
  gRNA target site sequence
aataaacacaatgatgcggaagg

SEQ ID NO: 3918 - DNA, 23 bp, Artificial
  gRNA target site sequence
atccaataaacacaatgatgcgg

SEQ ID NO: 3919 - DNA, 23 bp, Artificial
  gRNA target site sequence
ttgtgtcgacattctgtctgggg

SEQ ID NO: 3920 - DNA, 23 bp, Artificial
  gRNA target site sequence
tttgtgtcgacattctgtctggg

SEQ ID NO: 3921 - DNA, 23 bp, Artificial
  gRNA target site sequence
atttgtgtcgacattctgtctgg

SEQ ID NO: 3922 - DNA, 23 bp, Artificial
  gRNA target site sequence
gaatttataaaagagttcaatgg

SEQ ID NO: 3923 - DNA, 23 bp, Artificial
  gRNA target site sequence
attaccatacctggcaataaagg

SEQ ID NO: 3924 - DNA, 23 bp, Artificial
  gRNA target site sequence
gatatacagattaccatacctgg

SEQ ID NO: 3925 - DNA, 23 bp, Artificial
  gRNA target site sequence
atgtctctgtacttgagaacagg

SEQ ID NO: 3926 - DNA, 23 bp, Artificial
  gRNA target site sequence
caaagaaacgacgtttgccgcgg

SEQ ID NO: 3927 - DNA, 23 bp, Artificial
  gRNA target site sequence
gaaacgacgtttgccgcggtagg

SEQ ID NO: 3928 - DNA, 23 bp, Artificial
  gRNA target site sequence
gatgcggcataggtgatcaatgg

SEQ ID NO: 3929 - DNA, 23 bp, Artificial
  gRNA target site sequence
tcttttcaatgatgcggcatagg

SEQ ID NO: 3930 - DNA, 23 bp, Artificial
  gRNA target site sequence
catgcttcttttcaatgatgcgg

SEQ ID NO: 3931 - DNA, 23 bp, Artificial
  gRNA target site sequence
ggaagcaagatcacctaccgcgg

SEQ ID NO: 3932 - DNA, 23 bp, Artificial
  gRNA target site sequence
tttcctattctttattttacagg

SEQ ID NO: 3933 - DNA, 23 bp, Artificial
  gRNA target site sequence
ttcctattctttattttacaggg

SEQ ID NO: 3934 - DNA, 23 bp, Artificial
  gRNA target site sequence
ttacagggaagaagagtctctgg

SEQ ID NO: 3935 - DNA, 23 bp, Artificial
  gRNA target site sequence
cagggaagaagagtctctggtgg

SEQ ID NO: 3936 - DNA, 23 bp, Artificial
  gRNA target site sequence
acagtttgtgtttgaagccttgg

SEQ ID NO: 3937 - DNA, 23 bp, Artificial
  gRNA target site sequence
tgaagccttggtgatatacatgg

SEQ ID NO: 3938 - DNA, 23 bp, Artificial
  gRNA target site sequence
ggtgatatacatggagagtctgg

SEQ ID NO: 3939 - DNA, 23 bp, Artificial
  gRNA target site sequence
catgcagatgagaagtccttagg

SEQ ID NO: 3940 - DNA, 23 bp, Artificial
  gRNA target site sequence
ttccctgtaaaataaagaatagg

SEQ ID NO: 3941 - DNA, 23 bp, Artificial
  gRNA target site sequence
actctccatgtatatcaccaagg

SEQ ID NO: 3942 - DNA, 23 bp, Artificial
  gRNA target site sequence
cttctcatctgcatgtgctaagg

SEQ ID NO: 3943 - DNA, 23 bp, Artificial
  gRNA target site sequence
actgaagcaaaacgtacctaagg

SEQ ID NO: 3944 - DNA, 23 bp, Artificial
  gRNA target site sequence
aggtctctttgttttgtttcagg

SEQ ID NO: 3945 - DNA, 23 bp, Artificial
  gRNA target site sequence
ctctttgttttgtttcaggatgg

SEQ ID NO: 3946 - DNA, 23 bp, Artificial
  gRNA target site sequence
tttgtttcaggatggaattgtgg

SEQ ID NO: 3947 - DNA, 23 bp, Artificial
  gRNA target site sequence
agtactttaagagatttttgtgg

SEQ ID NO: 3948 - DNA, 23 bp, Artificial
  gRNA target site sequence
ctttaagagatttttgtggtcgg

SEQ ID NO: 3949 - DNA, 23 bp, Artificial
  gRNA target site sequence
gtattcgagaattccttaaatgg

SEQ ID NO: 3950 - DNA, 23 bp, Artificial
  gRNA target site sequence
gcaaataacaccacagcagcagg

SEQ ID NO: 3951 - DNA, 23 bp, Artificial
  gRNA target site sequence
ttcaccccaatgctttcaagagg

SEQ ID NO: 3952 - DNA, 23 bp, Artificial
  gRNA target site sequence
ccccaatgctttcaagaggctgg

SEQ ID NO: 3953 - DNA, 23 bp, Artificial
  gRNA target site sequence
cccaatgctttcaagaggctggg

SEQ ID NO: 3954 - DNA, 23 bp, Artificial
  gRNA target site sequence
ttgcctttaataatatctacagg

SEQ ID NO: 3955 - DNA, 23 bp, Artificial
  gRNA target site sequence
tgcctttaataatatctacaggg

SEQ ID NO: 3956 - DNA, 23 bp, Artificial
  gRNA target site sequence
ataatatctacagggaattcagg

SEQ ID NO: 3957 - DNA, 23 bp, Artificial
  gRNA target site sequence
ctcttaaagtactgtcaacaggg

SEQ ID NO: 3958 - DNA, 23 bp, Artificial
  gRNA target site sequence
tctcttaaagtactgtcaacagg

SEQ ID NO: 3959 - DNA, 23 bp, Artificial
  gRNA target site sequence
tttgcttaatggaccatttaagg

SEQ ID NO: 3960 - DNA, 23 bp, Artificial
  gRNA target site sequence
ctgtggtgttatttgcttaatgg

SEQ ID NO: 3961 - DNA, 23 bp, Artificial
  gRNA target site sequence
ggactcttctcctgctgctgtgg

SEQ ID NO: 3962 - DNA, 23 bp, Artificial
  gRNA target site sequence
aaaagcgatttggtgtttactgg

SEQ ID NO: 3963 - DNA, 23 bp, Artificial
  gRNA target site sequence
aagtcgcttgaaaagcgatttgg

SEQ ID NO: 3964 - DNA, 23 bp, Artificial
  gRNA target site sequence
aagcattggggtgaagcgcaagg

SEQ ID NO: 3965 - DNA, 23 bp, Artificial
  gRNA target site sequence
ccagcctcttgaaagcattgggg

SEQ ID NO: 3966 - DNA, 23 bp, Artificial
  gRNA target site sequence
cccagcctcttgaaagcattggg

SEQ ID NO: 3967 - DNA, 23 bp, Artificial
  gRNA target site sequence
tcccagcctcttgaaagcattgg

SEQ ID NO: 3968 - DNA, 23 bp, Artificial
  gRNA target site sequence
ttccctgtagatattattaaagg

SEQ ID NO: 3969 - DNA, 23 bp, Artificial
  gRNA target site sequence
tttaatggtattgtttcttcagg

SEQ ID NO: 3970 - DNA, 23 bp, Artificial
  gRNA target site sequence
tattgtttcttcaggtgacaagg

SEQ ID NO: 3971 - DNA, 23 bp, Artificial
  gRNA target site sequence
tagttatgcagctgattcactgg

SEQ ID NO: 3972 - DNA, 23 bp, Artificial
  gRNA target site sequence
caacaagaaatttgaaagtcagg

SEQ ID NO: 3973 - DNA, 23 bp, Artificial
  gRNA target site sequence
tgccttactagaagctatattgg

SEQ ID NO: 3974 - DNA, 23 bp, Artificial
  gRNA target site sequence
tgaatcagctgcataactagtgg

SEQ ID NO: 3975 - DNA, 23 bp, Artificial
  gRNA target site sequence
taccaatatagcttctagtaagg

SEQ ID NO: 3976 - DNA, 23 bp, Artificial
  gRNA target site sequence
ctgacctcctggtctgttttagg

SEQ ID NO: 3977 - DNA, 23 bp, Artificial
  gRNA target site sequence
ctgtgaacttttacatagcatgg

SEQ ID NO: 3978 - DNA, 23 bp, Artificial
  gRNA target site sequence
tagcatggttatgtttatgttgg

SEQ ID NO: 3979 - DNA, 23 bp, Artificial
  gRNA target site sequence
agcatggttatgtttatgttggg

SEQ ID NO: 3980 - DNA, 23 bp, Artificial
  gRNA target site sequence
aaagccacgcagatgccagaagg

SEQ ID NO: 3981 - DNA, 23 bp, Artificial
  gRNA target site sequence
aagccacgcagatgccagaaggg

SEQ ID NO: 3982 - DNA, 23 bp, Artificial
  gRNA target site sequence
agccacgcagatgccagaagggg

SEQ ID NO: 3983 - DNA, 23 bp, Artificial
  gRNA target site sequence
gccacgcagatgccagaaggggg

SEQ ID NO: 3984 - DNA, 23 bp, Artificial
  gRNA target site sequence
gcagatgccagaagggggacagg

SEQ ID NO: 3985 - DNA, 23 bp, Artificial
  gRNA target site sequence
cagatgccagaagggggacaggg

SEQ ID NO: 3986 - DNA, 23 bp, Artificial
  gRNA target site sequence
ccatgtaccagctctataagcgg

SEQ ID NO: 3987 - DNA, 23 bp, Artificial
  gRNA target site sequence
acttgcgtgtgatgttgatcagg

SEQ ID NO: 3988 - DNA, 23 bp, Artificial
  gRNA target site sequence
cgtgtgatgttgatcaggtaagg

SEQ ID NO: 3989 - DNA, 23 bp, Artificial
  gRNA target site sequence
gtgtgatgttgatcaggtaaggg

SEQ ID NO: 3990 - DNA, 23 bp, Artificial
  gRNA target site sequence
gcaacctaaaacagaccaggagg

SEQ ID NO: 3991 - DNA, 23 bp, Artificial
  gRNA target site sequence
gctgcaacctaaaacagaccagg

SEQ ID NO: 3992 - DNA, 23 bp, Artificial
  gRNA target site sequence
catgctatgtaaaagttcacagg

SEQ ID NO: 3993 - DNA, 23 bp, Artificial
  gRNA target site sequence
tcccccttctggcatctgcgtgg

SEQ ID NO: 3994 - DNA, 23 bp, Artificial
  gRNA target site sequence
ggggctccctgtcccccttctgg

SEQ ID NO: 3995 - DNA, 23 bp, Artificial
  gRNA target site sequence
atagagctggtacatgggtgggg

SEQ ID NO: 3996 - DNA, 23 bp, Artificial
  gRNA target site sequence
tatagagctggtacatgggtggg

SEQ ID NO: 3997 - DNA, 23 bp, Artificial
  gRNA target site sequence
ttatagagctggtacatgggtgg

SEQ ID NO: 3998 - DNA, 23 bp, Artificial
  gRNA target site sequence
cgcttatagagctggtacatggg

SEQ ID NO: 3999 - DNA, 23 bp, Artificial
  gRNA target site sequence
ccgcttatagagctggtacatgg

SEQ ID NO: 4000 - DNA, 23 bp, Artificial
  gRNA target site sequence
gaaacgtccgcttatagagctgg

SEQ ID NO: 4001 - DNA, 23 bp, Artificial
  gRNA target site sequence
cacgcaagtcgaagcagcacagg

SEQ ID NO: 4002 - DNA, 23 bp, Artificial
  gRNA target site sequence
tgagatgatgaagagctatgtgg

SEQ ID NO: 4003 - DNA, 23 bp, Artificial
  gRNA target site sequence
tgatgaagagctatgtggcctgg

SEQ ID NO: 4004 - DNA, 23 bp, Artificial
  gRNA target site sequence
gatgaagagctatgtggcctggg

SEQ ID NO: 4005 - DNA, 23 bp, Artificial
  gRNA target site sequence
tggcctgggacagagagaagcgg

SEQ ID NO: 4006 - DNA, 23 bp, Artificial
  gRNA target site sequence
gatgaaacctgtcattttcctgg

SEQ ID NO: 4007 - DNA, 23 bp, Artificial
  gRNA target site sequence
gctcttcatcatctcatctgagg

SEQ ID NO: 4008 - DNA, 23 bp, Artificial
  gRNA target site sequence
cagccgcttctctctgtcccagg

SEQ ID NO: 4009 - DNA, 23 bp, Artificial
  gRNA target site sequence
acaggtttcatctctctaaaggg

SEQ ID NO: 4010 - DNA, 23 bp, Artificial
  gRNA target site sequence
gacaggtttcatctctctaaagg

SEQ ID NO: 4011 - DNA, 23 bp, Artificial
  gRNA target site sequence
aacacatccaggaaaatgacagg

SEQ ID NO: 4012 - DNA, 23 bp, Artificial
  gRNA target site sequence
ctcgaggcaggaacacatccagg

SEQ ID NO: 4013 - DNA, 23 bp, Artificial
  gRNA target site sequence
ctaattctgtgactcgaggcagg

SEQ ID NO: 4014 - DNA, 23 bp, Artificial
  gRNA target site sequence
agcgctaattctgtgactcgagg

SEQ ID NO: 4015 - DNA, 23 bp, Artificial
  gRNA target site sequence
tactttagtttgtctgtcactgg

SEQ ID NO: 4016 - DNA, 23 bp, Artificial
  gRNA target site sequence
attagagtagtacaaatgcttgg

SEQ ID NO: 4017 - DNA, 23 bp, Artificial
  gRNA target site sequence
gtacaaatgcttggatctctagg

SEQ ID NO: 4018 - DNA, 23 bp, Artificial
  gRNA target site sequence
caaatgcttggatctctaggagg

SEQ ID NO: 4019 - DNA, 23 bp, Artificial
  gRNA target site sequence
ataaacaaaaatcttctgacagg

SEQ ID NO: 4020 - DNA, 23 bp, Artificial
  gRNA target site sequence
tctaattcttatttcttctaagg

SEQ ID NO: 4021 - DNA, 23 bp, Artificial
  gRNA target site sequence
tagatgagaccaagaataactgg

SEQ ID NO: 4022 - DNA, 23 bp, Artificial
  gRNA target site sequence
agatgagaccaagaataactggg

SEQ ID NO: 4023 - DNA, 23 bp, Artificial
  gRNA target site sequence
gggaagtgtcagctctttctcgg

SEQ ID NO: 4024 - DNA, 23 bp, Artificial
  gRNA target site sequence
ggaagtgtcagctctttctcggg

SEQ ID NO: 4025 - DNA, 23 bp, Artificial
  gRNA target site sequence
ctttctcgggctgcccagaaagg

SEQ ID NO: 4026 - DNA, 23 bp, Artificial
  gRNA target site sequence
ccagaaaggatttaataaagtgg

SEQ ID NO: 4027 - DNA, 23 bp, Artificial
  gRNA target site sequence
tgacacttcccagttattcttgg

SEQ ID NO: 4028 - DNA, 23 bp, Artificial
  gRNA target site sequence
cactttattaaatcctttctggg

SEQ ID NO: 4029 - DNA, 23 bp, Artificial
  gRNA target site sequence
ccactttattaaatcctttctgg

SEQ ID NO: 4030 - DNA, 23 bp, Artificial
  gRNA target site sequence
aaggacttcttactgatgaaagg

SEQ ID NO: 4031 - DNA, 23 bp, Artificial
  gRNA target site sequence
tgtttgtattaacatacagatgg

SEQ ID NO: 4032 - DNA, 23 bp, Artificial
  gRNA target site sequence
catacagatggctttcaaactgg

SEQ ID NO: 4033 - DNA, 23 bp, Artificial
  gRNA target site sequence
atacagatggctttcaaactggg

SEQ ID NO: 4034 - DNA, 23 bp, Artificial
  gRNA target site sequence
gggcctgagctatacccccttgg

SEQ ID NO: 4035 - DNA, 23 bp, Artificial
  gRNA target site sequence
tatacccccttggcagaagtagg

SEQ ID NO: 4036 - DNA, 23 bp, Artificial
  gRNA target site sequence
gcctgaatgctctagaagaatgg

SEQ ID NO: 4037 - DNA, 23 bp, Artificial
  gRNA target site sequence
caaagacattctcccctgcctgg

SEQ ID NO: 4038 - DNA, 23 bp, Artificial
  gRNA target site sequence
gacattctcccctgcctggatgg

SEQ ID NO: 4039 - DNA, 23 bp, Artificial
  gRNA target site sequence
ctgaagacttcagccttgtcagg

SEQ ID NO: 4040 - DNA, 23 bp, Artificial
  gRNA target site sequence
ctgccaagggggtatagctcagg

SEQ ID NO: 4041 - DNA, 23 bp, Artificial
  gRNA target site sequence
caggcctacttctgccaaggggg

SEQ ID NO: 4042 - DNA, 23 bp, Artificial
  gRNA target site sequence
tcaggcctacttctgccaagggg

SEQ ID NO: 4043 - DNA, 23 bp, Artificial
  gRNA target site sequence
ttcaggcctacttctgccaaggg

SEQ ID NO: 4044 - DNA, 23 bp, Artificial
  gRNA target site sequence
attcaggcctacttctgccaagg

SEQ ID NO: 4045 - DNA, 23 bp, Artificial
  gRNA target site sequence
accattcttctagagcattcagg

SEQ ID NO: 4046 - DNA, 23 bp, Artificial
  gRNA target site sequence
gggagaatgtctttgtaataagg

SEQ ID NO: 4047 - DNA, 23 bp, Artificial
  gRNA target site sequence
tcaggtatccatccaggcagggg

SEQ ID NO: 4048 - DNA, 23 bp, Artificial
  gRNA target site sequence
ttcaggtatccatccaggcaggg

SEQ ID NO: 4049 - DNA, 23 bp, Artificial
  gRNA target site sequence
cttcaggtatccatccaggcagg

SEQ ID NO: 4050 - DNA, 23 bp, Artificial
  gRNA target site sequence
aagtcttcaggtatccatccagg

SEQ ID NO: 4051 - DNA, 23 bp, Artificial
  gRNA target site sequence
ctgacaaggctgaagtcttcagg

SEQ ID NO: 4052 - DNA, 23 bp, Artificial
  gRNA target site sequence
cttctaaacattacctgacaagg

SEQ ID NO: 4053 - DNA, 23 bp, Artificial
  gRNA target site sequence
tactgtcttctttcttgttaagg

SEQ ID NO: 4054 - DNA, 23 bp, Artificial
  gRNA target site sequence
tgtcttctttcttgttaaggtgg

SEQ ID NO: 4055 - DNA, 23 bp, Artificial
  gRNA target site sequence
gcagtacaaagatgaacttttgg

SEQ ID NO: 4056 - DNA, 23 bp, Artificial
  gRNA target site sequence
agcctacgttcctgcactgcagg

SEQ ID NO: 4057 - DNA, 23 bp, Artificial
  gRNA target site sequence
tacgttcctgcactgcaggtagg

SEQ ID NO: 4058 - DNA, 23 bp, Artificial
  gRNA target site sequence
cagaagaaaggtcaaacaagagg

SEQ ID NO: 4059 - DNA, 23 bp, Artificial
  gRNA target site sequence
gtgtggcaaggacagaagaaagg

SEQ ID NO: 4060 - DNA, 23 bp, Artificial
  gRNA target site sequence
ttcaatgatgttgtgtggcaagg

SEQ ID NO: 4061 - DNA, 23 bp, Artificial
  gRNA target site sequence
tcgagttcaatgatgttgtgtgg

SEQ ID NO: 4062 - DNA, 23 bp, Artificial
  gRNA target site sequence
tacctgcagtgcaggaacgtagg

SEQ ID NO: 4063 - DNA, 23 bp, Artificial
  gRNA target site sequence
acaacgcctacctgcagtgcagg

SEQ ID NO: 4064 - DNA, 23 bp, Artificial
  gRNA target site sequence
aacttgctgttttatttgacagg

SEQ ID NO: 4065 - DNA, 23 bp, Artificial
  gRNA target site sequence
acttgctgttttatttgacaggg

SEQ ID NO: 4066 - DNA, 23 bp, Artificial
  gRNA target site sequence
tttgctttatttgtgaaatttgg

SEQ ID NO: 4067 - DNA, 23 bp, Artificial
  gRNA target site sequence
atttgtgaaatttggcaaagagg

SEQ ID NO: 4068 - DNA, 23 bp, Artificial
  gRNA target site sequence
ggagagtgtttcagactctttgg

SEQ ID NO: 4069 - DNA, 23 bp, Artificial
  gRNA target site sequence
gaatacttttctgggtcttcagg

SEQ ID NO: 4070 - DNA, 23 bp, Artificial
  gRNA target site sequence
caaagcaagaatacttttctggg

SEQ ID NO: 4071 - DNA, 23 bp, Artificial
  gRNA target site sequence
gcaaagcaagaatacttttctgg

SEQ ID NO: 4072 - DNA, 23 bp, Artificial
  gRNA target site sequence
aagcagaattttttgaaccatgg

SEQ ID NO: 4073 - DNA, 23 bp, Artificial
  gRNA target site sequence
agcagaattttttgaaccatggg

SEQ ID NO: 4074 - DNA, 23 bp, Artificial
  gRNA target site sequence
aattaattttgcaatctacaagg

SEQ ID NO: 4075 - DNA, 23 bp, Artificial
  gRNA target site sequence
acaaggttgcccctcatcagtgg

SEQ ID NO: 4076 - DNA, 23 bp, Artificial
  gRNA target site sequence
caagaaaataaaatatttcgagg

SEQ ID NO: 4077 - DNA, 23 bp, Artificial
  gRNA target site sequence
tcgaggtgagtctttcttgcagg

SEQ ID NO: 4078 - DNA, 23 bp, Artificial
  gRNA target site sequence
aaaattctgcttgtttctcaggg

SEQ ID NO: 4079 - DNA, 23 bp, Artificial
  gRNA target site sequence
aaaaattctgcttgtttctcagg

SEQ ID NO: 4080 - DNA, 23 bp, Artificial
  gRNA target site sequence
tatgaaaatgagtacacccatgg

SEQ ID NO: 4081 - DNA, 23 bp, Artificial
  gRNA target site sequence
ttgtagaaaccactgatgagggg

SEQ ID NO: 4082 - DNA, 23 bp, Artificial
  gRNA target site sequence
tttgtagaaaccactgatgaggg

SEQ ID NO: 4083 - DNA, 23 bp, Artificial
  gRNA target site sequence
atttgtagaaaccactgatgagg

SEQ ID NO: 4084 - DNA, 23 bp, Artificial
  gRNA target site sequence
ctcgaaatattttattttcttgg

SEQ ID NO: 4085 - DNA, 23 bp, Artificial
  gRNA target site sequence
ctacaattactctttaagaatgg

SEQ ID NO: 4086 - DNA, 23 bp, Artificial
  gRNA target site sequence
actctttaagaatggagatgagg

SEQ ID NO: 4087 - DNA, 23 bp, Artificial
  gRNA target site sequence
aagaatggagatgaggcgcctgg

SEQ ID NO: 4088 - DNA, 23 bp, Artificial
  gRNA target site sequence
gagatgaggcgcctggtgtttgg

SEQ ID NO: 4089 - DNA, 23 bp, Artificial
  gRNA target site sequence
gatcccaacttcagatccagcgg

SEQ ID NO: 4090 - DNA, 23 bp, Artificial
  gRNA target site sequence
agctaaacctaaagatttttcgg

SEQ ID NO: 4091 - DNA, 23 bp, Artificial
  gRNA target site sequence
tttttcggctttcattaacctgg

SEQ ID NO: 4092 - DNA, 23 bp, Artificial
  gRNA target site sequence
ttcggctttcattaacctggtgg

SEQ ID NO: 4093 - DNA, 23 bp, Artificial
  gRNA target site sequence
ttaacctggtggaattttgcagg

SEQ ID NO: 4094 - DNA, 23 bp, Artificial
  gRNA target site sequence
ggtggaattttgcaggtatttgg

SEQ ID NO: 4095 - DNA, 23 bp, Artificial
  gRNA target site sequence
gttgggatcatccaaacaccagg

SEQ ID NO: 4096 - DNA, 23 bp, Artificial
  gRNA target site sequence
tagccgctggatctgaagttggg

SEQ ID NO: 4097 - DNA, 23 bp, Artificial
  gRNA target site sequence
ttagccgctggatctgaagttgg

SEQ ID NO: 4098 - DNA, 23 bp, Artificial
  gRNA target site sequence
gctggatgcaagttagccgctgg

SEQ ID NO: 4099 - DNA, 23 bp, Artificial
  gRNA target site sequence
gaaaaatctttaggtttagctgg

SEQ ID NO: 4100 - DNA, 23 bp, Artificial
  gRNA target site sequence
atgaaagccgaaaaatctttagg

SEQ ID NO: 4101 - DNA, 23 bp, Artificial
  gRNA target site sequence
aatacctgcaaaattccaccagg

SEQ ID NO: 4102 - DNA, 23 bp, Artificial
  gRNA target site sequence
tattgtttttctttatttaaagg

SEQ ID NO: 4103 - DNA, 23 bp, Artificial
  gRNA target site sequence
tttgaagattgttgagaaattgg

SEQ ID NO: 4104 - DNA, 23 bp, Artificial
  gRNA target site sequence
acacttgaaatacagactgttgg

SEQ ID NO: 4105 - DNA, 23 bp, Artificial
  gRNA target site sequence
cacttgaaatacagactgttggg

SEQ ID NO: 4106 - DNA, 23 bp, Artificial
  gRNA target site sequence
acttgaaatacagactgttgggg

SEQ ID NO: 4107 - DNA, 23 bp, Artificial
  gRNA target site sequence
acagactgttggggaacaagagg

SEQ ID NO: 4108 - DNA, 23 bp, Artificial
  gRNA target site sequence
atgattcagactttcactggagg

SEQ ID NO: 4109 - DNA, 23 bp, Artificial
  gRNA target site sequence
taaatgattcagactttcactgg

SEQ ID NO: 4110 - DNA, 23 bp, Artificial
  gRNA target site sequence
tttctcaacaatcttcaaaacgg

SEQ ID NO: 4111 - DNA, 23 bp, Artificial
  gRNA target site sequence
gtcatgctgtctttctggccagg

SEQ ID NO: 4112 - DNA, 23 bp, Artificial
  gRNA target site sequence
tcatgctgtctttctggccaggg

SEQ ID NO: 4113 - DNA, 23 bp, Artificial
  gRNA target site sequence
tctgaagaccaccgtgcttcagg

SEQ ID NO: 4114 - DNA, 23 bp, Artificial
  gRNA target site sequence
ctgaagaccaccgtgcttcaggg

SEQ ID NO: 4115 - DNA, 23 bp, Artificial
  gRNA target site sequence
tgaagaccaccgtgcttcagggg

SEQ ID NO: 4116 - DNA, 23 bp, Artificial
  gRNA target site sequence
gcttcaggggaagtcagaactgg

SEQ ID NO: 4117 - DNA, 23 bp, Artificial
  gRNA target site sequence
gggaagtcagaactggcaaatgg

SEQ ID NO: 4118 - DNA, 23 bp, Artificial
  gRNA target site sequence
agtcagaactggcaaatggaagg

SEQ ID NO: 4119 - DNA, 23 bp, Artificial
  gRNA target site sequence
gcccacatacaaagactacgtgg

SEQ ID NO: 4120 - DNA, 23 bp, Artificial
  gRNA target site sequence
cctgagctctgaccagatgatgg

SEQ ID NO: 4121 - DNA, 23 bp, Artificial
  gRNA target site sequence
cagattcagactcagggccctgg

SEQ ID NO: 4122 - DNA, 23 bp, Artificial
  gRNA target site sequence
ggtcttcagattcagactcaggg

SEQ ID NO: 4123 - DNA, 23 bp, Artificial
  gRNA target site sequence
tggtcttcagattcagactcagg

SEQ ID NO: 4124 - DNA, 23 bp, Artificial
  gRNA target site sequence
tgacttcccctgaagcacggtgg

SEQ ID NO: 4125 - DNA, 23 bp, Artificial
  gRNA target site sequence
ttctgacttcccctgaagcacgg

SEQ ID NO: 4126 - DNA, 23 bp, Artificial
  gRNA target site sequence
tccacgtagtctttgtatgtggg

SEQ ID NO: 4127 - DNA, 23 bp, Artificial
  gRNA target site sequence
atccacgtagtctttgtatgtgg

SEQ ID NO: 4128 - DNA, 23 bp, Artificial
  gRNA target site sequence
ccatcatctggtcagagctcagg

SEQ ID NO: 4129 - DNA, 23 bp, Artificial
  gRNA target site sequence
tggtaaatgttaccatcatctgg

SEQ ID NO: 4130 - DNA, 23 bp, Artificial
  gRNA target site sequence
ttttcttttttcagtgcatcagg

SEQ ID NO: 4131 - DNA, 23 bp, Artificial
  gRNA target site sequence
tttcttttttcagtgcatcaggg

SEQ ID NO: 4132 - DNA, 23 bp, Artificial
  gRNA target site sequence
cagaatatgttctaaaccagtgg

SEQ ID NO: 4133 - DNA, 23 bp, Artificial
  gRNA target site sequence
taaaccagtggtccttccaaagg

SEQ ID NO: 4134 - DNA, 23 bp, Artificial
  gRNA target site sequence
tttacctttggaaggaccactgg

SEQ ID NO: 4135 - DNA, 23 bp, Artificial
  gRNA target site sequence
attcagaatttacctttggaagg

SEQ ID NO: 4136 - DNA, 23 bp, Artificial
  gRNA target site sequence
ttaaattcagaatttacctttgg

SEQ ID NO: 4137 - DNA, 23 bp, Artificial
  gRNA target site sequence
gtttgctgattatttccggtagg

SEQ ID NO: 4138 - DNA, 23 bp, Artificial
  gRNA target site sequence
ttatttccggtaggttcctgagg

SEQ ID NO: 4139 - DNA, 23 bp, Artificial
  gRNA target site sequence
tgaggtgtatactccagttctgg

SEQ ID NO: 4140 - DNA, 23 bp, Artificial
  gRNA target site sequence
tccagttctggagcacctcgtgg

SEQ ID NO: 4141 - DNA, 23 bp, Artificial
  gRNA target site sequence
gtacagtccaaaaatgcagctgg

SEQ ID NO: 4142 - DNA, 23 bp, Artificial
  gRNA target site sequence
gtgttgcagagccatagtgaagg

SEQ ID NO: 4143 - DNA, 23 bp, Artificial
  gRNA target site sequence
agtgaaggtgttcctagctttgg

SEQ ID NO: 4144 - DNA, 23 bp, Artificial
  gRNA target site sequence
ttcctagctttggcagcaaaagg

SEQ ID NO: 4145 - DNA, 23 bp, Artificial
  gRNA target site sequence
tcctagctttggcagcaaaaggg

SEQ ID NO: 4146 - DNA, 23 bp, Artificial
  gRNA target site sequence
cagcaaaagggccagttctcagg

SEQ ID NO: 4147 - DNA, 23 bp, Artificial
  gRNA target site sequence
caggaattgcattagtactgtgg

SEQ ID NO: 4148 - DNA, 23 bp, Artificial
  gRNA target site sequence
aggaattgcattagtactgtggg

SEQ ID NO: 4149 - DNA, 23 bp, Artificial
  gRNA target site sequence
tatacacctcaggaacctaccgg

SEQ ID NO: 4150 - DNA, 23 bp, Artificial
  gRNA target site sequence
agaactggagtatacacctcagg

SEQ ID NO: 4151 - DNA, 23 bp, Artificial
  gRNA target site sequence
accacgaggtgctccagaactgg

SEQ ID NO: 4152 - DNA, 23 bp, Artificial
  gRNA target site sequence
tgtctatctgcatcaccacgagg

SEQ ID NO: 4153 - DNA, 23 bp, Artificial
  gRNA target site sequence
gcatttttggactgtactgtggg

SEQ ID NO: 4154 - DNA, 23 bp, Artificial
  gRNA target site sequence
tgcatttttggactgtactgtgg

SEQ ID NO: 4155 - DNA, 23 bp, Artificial
  gRNA target site sequence
caacacaccagctgcatttttgg

SEQ ID NO: 4156 - DNA, 23 bp, Artificial
  gRNA target site sequence
agctaggaacaccttcactatgg

SEQ ID NO: 4157 - DNA, 23 bp, Artificial
  gRNA target site sequence
gcccttttgctgccaaagctagg

SEQ ID NO: 4158 - DNA, 23 bp, Artificial
  gRNA target site sequence
ctaatgcaattcctgagaactgg

SEQ ID NO: 4159 - DNA, 23 bp, Artificial
  gRNA target site sequence
accttttctaaagccgtgcaagg

SEQ ID NO: 4160 - DNA, 23 bp, Artificial
  gRNA target site sequence
ttcctcacccagacagacactgg

SEQ ID NO: 4161 - DNA, 23 bp, Artificial
  gRNA target site sequence
accttgcacggctttagaaaagg

SEQ ID NO: 4162 - DNA, 23 bp, Artificial
  gRNA target site sequence
tttgcgtttataaccttgcacgg

SEQ ID NO: 4163 - DNA, 23 bp, Artificial
  gRNA target site sequence
caccagtgtctgtctgggtgagg

SEQ ID NO: 4164 - DNA, 23 bp, Artificial
  gRNA target site sequence
gtcgtcaccagtgtctgtctggg

SEQ ID NO: 4165 - DNA, 23 bp, Artificial
  gRNA target site sequence
ggtcgtcaccagtgtctgtctgg

SEQ ID NO: 4166 - DNA, 23 bp, Artificial
  gRNA target site sequence
agcttggcatctgataaacacgg

SEQ ID NO: 4167 - DNA, 23 bp, Artificial
  gRNA target site sequence
gcaacagactggaggaagcttgg

SEQ ID NO: 4168 - DNA, 23 bp, Artificial
  gRNA target site sequence
agacgcttgcaacagactggagg

SEQ ID NO: 4169 - DNA, 23 bp, Artificial
  gRNA target site sequence
gcaagacgcttgcaacagactgg

SEQ ID NO: 4170 - DNA, 23 bp, Artificial
  gRNA target site sequence
ttagttcacttactgtgtcaagg

SEQ ID NO: 4171 - DNA, 23 bp, Artificial
  gRNA target site sequence
aataaatattatgtatttgcagg

SEQ ID NO: 4172 - DNA, 23 bp, Artificial
  gRNA target site sequence
gtatttgcaggtttctaatatgg

SEQ ID NO: 4173 - DNA, 23 bp, Artificial
  gRNA target site sequence
tttgcaggtttctaatatggtgg

SEQ ID NO: 4174 - DNA, 23 bp, Artificial
  gRNA target site sequence
aaataaactgcagtactttatgg

SEQ ID NO: 4175 - DNA, 23 bp, Artificial
  gRNA target site sequence
tactttatggagcagttttatgg

SEQ ID NO: 4176 - DNA, 23 bp, Artificial
  gRNA target site sequence
ttatggaatcatcagaaatgtgg

SEQ ID NO: 4177 - DNA, 23 bp, Artificial
  gRNA target site sequence
aaatgtggattcgaacaacaagg

SEQ ID NO: 4178 - DNA, 23 bp, Artificial
  gRNA target site sequence
gagttatctattgctatccgtgg

SEQ ID NO: 4179 - DNA, 23 bp, Artificial
  gRNA target site sequence
tctattgctatccgtggatatgg

SEQ ID NO: 4180 - DNA, 23 bp, Artificial
  gRNA target site sequence
cgtggatatggactttttgcagg

SEQ ID NO: 4181 - DNA, 23 bp, Artificial
  gRNA target site sequence
ctgcaaaaagtccatatccacgg

SEQ ID NO: 4182 - DNA, 23 bp, Artificial
  gRNA target site sequence
atggcatttgcatttgcagctgg

SEQ ID NO: 4183 - DNA, 23 bp, Artificial
  gRNA target site sequence
tcagtttagcacctgccttctgg

SEQ ID NO: 4184 - DNA, 23 bp, Artificial
  gRNA target site sequence
tatttgaagtcttgttaaagtgg

SEQ ID NO: 4185 - DNA, 23 bp, Artificial
  gRNA target site sequence
aaaagctgcactttcagccctgg

SEQ ID NO: 4186 - DNA, 23 bp, Artificial
  gRNA target site sequence
cctggaatcctttctgaaacagg

SEQ ID NO: 4187 - DNA, 23 bp, Artificial
  gRNA target site sequence
gagatgcatgcagggcaaatagg

SEQ ID NO: 4188 - DNA, 23 bp, Artificial
  gRNA target site sequence
gctaaactgagatgcatgcaggg

SEQ ID NO: 4189 - DNA, 23 bp, Artificial
  gRNA target site sequence
tgctaaactgagatgcatgcagg

SEQ ID NO: 4190 - DNA, 23 bp, Artificial
  gRNA target site sequence
cacgtagttgtccagaaggcagg

SEQ ID NO: 4191 - DNA, 23 bp, Artificial
  gRNA target site sequence
gagacacgtagttgtccagaagg

SEQ ID NO: 4192 - DNA, 23 bp, Artificial
  gRNA target site sequence
tttcaattctacatttgtgtggg

SEQ ID NO: 4193 - DNA, 23 bp, Artificial
  gRNA target site sequence
ttttcaattctacatttgtgtgg

SEQ ID NO: 4194 - DNA, 23 bp, Artificial
  gRNA target site sequence
ctgtttcagaaaggattccaggg

SEQ ID NO: 4195 - DNA, 23 bp, Artificial
  gRNA target site sequence
cctgtttcagaaaggattccagg

SEQ ID NO: 4196 - DNA, 23 bp, Artificial
  gRNA target site sequence
ttgtggtacctgtttcagaaagg

SEQ ID NO: 4197 - DNA, 23 bp, Artificial
  gRNA target site sequence
aagagatatgctgtgccctcagg

SEQ ID NO: 4198 - DNA, 23 bp, Artificial
  gRNA target site sequence
gatatgctgtgccctcaggtagg

SEQ ID NO: 4199 - DNA, 23 bp, Artificial
  gRNA target site sequence
gtaggattctgtttataatgagg

SEQ ID NO: 4200 - DNA, 23 bp, Artificial
  gRNA target site sequence
ataaacagaatcctacctgaggg

SEQ ID NO: 4201 - DNA, 23 bp, Artificial
  gRNA target site sequence
tataaacagaatcctacctgagg

SEQ ID NO: 4202 - DNA, 23 bp, Artificial
  gRNA target site sequence
ccctagatccccagacttcaagg

SEQ ID NO: 4203 - DNA, 23 bp, Artificial
  gRNA target site sequence
cctagatccccagacttcaaggg

SEQ ID NO: 4204 - DNA, 23 bp, Artificial
  gRNA target site sequence
gatttttaattttgtactaaagg

SEQ ID NO: 4205 - DNA, 23 bp, Artificial
  gRNA target site sequence
actaaaggcaattcgtcctcagg

SEQ ID NO: 4206 - DNA, 23 bp, Artificial
  gRNA target site sequence
aaggcaattcgtcctcaggtagg

SEQ ID NO: 4207 - DNA, 23 bp, Artificial
  gRNA target site sequence
ccttgaagtctggggatctaggg

SEQ ID NO: 4208 - DNA, 23 bp, Artificial
  gRNA target site sequence
cccttgaagtctggggatctagg

SEQ ID NO: 4209 - DNA, 23 bp, Artificial
  gRNA target site sequence
aaaatctcccttgaagtctgggg

SEQ ID NO: 4210 - DNA, 23 bp, Artificial
  gRNA target site sequence
aaaaatctcccttgaagtctggg

SEQ ID NO: 4211 - DNA, 23 bp, Artificial
  gRNA target site sequence
taaaaatctcccttgaagtctgg

SEQ ID NO: 4212 - DNA, 23 bp, Artificial
  gRNA target site sequence
agtaatattaatcctacctgagg

SEQ ID NO: 4213 - DNA, 23 bp, Artificial
  gRNA target site sequence
agagcccaaactacctgttctgg

SEQ ID NO: 4214 - DNA, 23 bp, Artificial
  gRNA target site sequence
cccaaactacctgttctggcagg

SEQ ID NO: 4215 - DNA, 23 bp, Artificial
  gRNA target site sequence
tgttctggcaggatgtctgaagg

SEQ ID NO: 4216 - DNA, 23 bp, Artificial
  gRNA target site sequence
gttctggcaggatgtctgaaggg

SEQ ID NO: 4217 - DNA, 23 bp, Artificial
  gRNA target site sequence
ttctggcaggatgtctgaagggg

SEQ ID NO: 4218 - DNA, 23 bp, Artificial
  gRNA target site sequence
gtgcaacttcactaagtccatgg

SEQ ID NO: 4219 - DNA, 23 bp, Artificial
  gRNA target site sequence
ttcactaagtccatggaagaagg

SEQ ID NO: 4220 - DNA, 23 bp, Artificial
  gRNA target site sequence
ccatggaagaaggtattgcttgg

SEQ ID NO: 4221 - DNA, 23 bp, Artificial
  gRNA target site sequence
cctgccagaacaggtagtttggg

SEQ ID NO: 4222 - DNA, 23 bp, Artificial
  gRNA target site sequence
tcctgccagaacaggtagtttgg

SEQ ID NO: 4223 - DNA, 23 bp, Artificial
  gRNA target site sequence
ttcagacatcctgccagaacagg

SEQ ID NO: 4224 - DNA, 23 bp, Artificial
  gRNA target site sequence
agtgaagttgcacagaagtgagg

SEQ ID NO: 4225 - DNA, 23 bp, Artificial
  gRNA target site sequence
ccaagcaataccttcttccatgg

SEQ ID NO: 4226 - DNA, 23 bp, Artificial
  gRNA target site sequence
gaaaaagtatatgagctcctagg

SEQ ID NO: 4227 - DNA, 23 bp, Artificial
  gRNA target site sequence
atatgagctcctaggattattgg

SEQ ID NO: 4228 - DNA, 23 bp, Artificial
  gRNA target site sequence
tatgagctcctaggattattggg

SEQ ID NO: 4229 - DNA, 23 bp, Artificial
  gRNA target site sequence
aaacctgttccgcgcttttctgg

SEQ ID NO: 4230 - DNA, 23 bp, Artificial
  gRNA target site sequence
aacctgttccgcgcttttctggg

SEQ ID NO: 4231 - DNA, 23 bp, Artificial
  gRNA target site sequence
tctgggtgaacttaagacccagg

SEQ ID NO: 4232 - DNA, 23 bp, Artificial
  gRNA target site sequence
gaacttcacccaataatcctagg

SEQ ID NO: 4233 - DNA, 23 bp, Artificial
  gRNA target site sequence
gcattatttatcatctcactagg

SEQ ID NO: 4234 - DNA, 23 bp, Artificial
  gRNA target site sequence
cacccagaaaagcgcggaacagg

SEQ ID NO: 4235 - DNA, 23 bp, Artificial
  gRNA target site sequence
taagttcacccagaaaagcgcgg

SEQ ID NO: 4236 - DNA, 23 bp, Artificial
  gRNA target site sequence
tcataaagttcatcatacctggg

SEQ ID NO: 4237 - DNA, 23 bp, Artificial
  gRNA target site sequence
gtcataaagttcatcatacctgg

SEQ ID NO: 4238 - DNA, 23 bp, Artificial
  gRNA target site sequence
ttttagaagttctagactcatgg

SEQ ID NO: 4239 - DNA, 23 bp, Artificial
  gRNA target site sequence
ctcatggatgaatttaaaattgg

SEQ ID NO: 4240 - DNA, 23 bp, Artificial
  gRNA target site sequence
gaattatttagtaaattctatgg

SEQ ID NO: 4241 - DNA, 23 bp, Artificial
  gRNA target site sequence
aaaaaaaaaataccagatacagg

SEQ ID NO: 4242 - DNA, 23 bp, Artificial
  gRNA target site sequence
aaatgcatctcacctgtatctgg

SEQ ID NO: 4243 - DNA, 23 bp, Artificial
  gRNA target site sequence
taaatgtaaaattccagccctgg

SEQ ID NO: 4244 - DNA, 23 bp, Artificial
  gRNA target site sequence
agccctggaccttcttattaagg

SEQ ID NO: 4245 - DNA, 23 bp, Artificial
  gRNA target site sequence
aacactggtacaagtgttctagg

SEQ ID NO: 4246 - DNA, 23 bp, Artificial
  gRNA target site sequence
tctatcttttgtataaacactgg

SEQ ID NO: 4247 - DNA, 23 bp, Artificial
  gRNA target site sequence
ttaataagaaggtccagggctgg

SEQ ID NO: 4248 - DNA, 23 bp, Artificial
  gRNA target site sequence
taccttaataagaaggtccaggg

SEQ ID NO: 4249 - DNA, 23 bp, Artificial
  gRNA target site sequence
ttaccttaataagaaggtccagg

SEQ ID NO: 4250 - DNA, 23 bp, Artificial
  gRNA target site sequence
acataattaccttaataagaagg

SEQ ID NO: 4251 - DNA, 23 bp, Artificial
  gRNA target site sequence
atgtattttcttagaaaaaatgg

SEQ ID NO: 4252 - DNA, 23 bp, Artificial
  gRNA target site sequence
tgtattttcttagaaaaaatggg

SEQ ID NO: 4253 - DNA, 23 bp, Artificial
  gRNA target site sequence
accttactctgttgaaattaagg

SEQ ID NO: 4254 - DNA, 23 bp, Artificial
  gRNA target site sequence
agaaaatacataaaaactttagg

SEQ ID NO: 4255 - DNA, 23 bp, Artificial
  gRNA target site sequence
cagagtaaggtgcgatcttctgg

SEQ ID NO: 4256 - DNA, 23 bp, Artificial
  gRNA target site sequence
accttaatttcaacagagtaagg

SEQ ID NO: 4257 - DNA, 23 bp, Artificial
  gRNA target site sequence
ttagttttttccagagatttcgg

SEQ ID NO: 4258 - DNA, 23 bp, Artificial
  gRNA target site sequence
tcggtttgcttgtatttgtccgg

SEQ ID NO: 4259 - DNA, 23 bp, Artificial
  gRNA target site sequence
ttgaagtaagttgacaattttgg

SEQ ID NO: 4260 - DNA, 23 bp, Artificial
  gRNA target site sequence
tacaagcaaaccgaaatctctgg

SEQ ID NO: 4261 - DNA, 23 bp, Artificial
  gRNA target site sequence
caatactgttgagtgacttccgg

SEQ ID NO: 4262 - DNA, 23 bp, Artificial
  gRNA target site sequence
cgcgcgggagcgggactcggcgg

SEQ ID NO: 4263 - DNA, 23 bp, Artificial
  gRNA target site sequence
gggagcgggactcggcggcatgg

SEQ ID NO: 4264 - DNA, 23 bp, Artificial
  gRNA target site sequence
agcgggactcggcggcatggcgg

SEQ ID NO: 4265 - DNA, 23 bp, Artificial
  gRNA target site sequence
gcgggactcggcggcatggcggg

SEQ ID NO: 4266 - DNA, 23 bp, Artificial
  gRNA target site sequence
ctcggcggcatggcgggctccgg

SEQ ID NO: 4267 - DNA, 23 bp, Artificial
  gRNA target site sequence
ggcatggcgggctccggagccgg

SEQ ID NO: 4268 - DNA, 23 bp, Artificial
  gRNA target site sequence
gtgtgcgttgctccctgctgcgg

SEQ ID NO: 4269 - DNA, 23 bp, Artificial
  gRNA target site sequence
ttgctccctgctgcggctgcagg

SEQ ID NO: 4270 - DNA, 23 bp, Artificial
  gRNA target site sequence
gcaggagaccttgtccgctgcgg

SEQ ID NO: 4271 - DNA, 23 bp, Artificial
  gRNA target site sequence
ttgtccgctgcggaccgctgcgg

SEQ ID NO: 4272 - DNA, 23 bp, Artificial
  gRNA target site sequence
ggaccgctgcggtgctgccctgg

SEQ ID NO: 4273 - DNA, 23 bp, Artificial
  gRNA target site sequence
cgctgcggtgctgccctggccgg

SEQ ID NO: 4274 - DNA, 23 bp, Artificial
  gRNA target site sequence
gccggtcatcaactgatccgcgg

SEQ ID NO: 4275 - DNA, 23 bp, Artificial
  gRNA target site sequence
tcatcaactgatccgcggcctgg

SEQ ID NO: 4276 - DNA, 23 bp, Artificial
  gRNA target site sequence
catcaactgatccgcggcctggg

SEQ ID NO: 4277 - DNA, 23 bp, Artificial
  gRNA target site sequence
atcaactgatccgcggcctgggg

SEQ ID NO: 4278 - DNA, 23 bp, Artificial
  gRNA target site sequence
actgatccgcggcctggggcagg

SEQ ID NO: 4279 - DNA, 23 bp, Artificial
  gRNA target site sequence
cgtcctgagcagcagccccgcgg

SEQ ID NO: 4280 - DNA, 23 bp, Artificial
  gRNA target site sequence
gagcagcagccccgcggtgctgg

SEQ ID NO: 4281 - DNA, 23 bp, Artificial
  gRNA target site sequence
agcagcagccccgcggtgctggg

SEQ ID NO: 4282 - DNA, 23 bp, Artificial
  gRNA target site sequence
agcagccccgcggtgctgggtgg

SEQ ID NO: 4283 - DNA, 23 bp, Artificial
  gRNA target site sequence
gcagccccgcggtgctgggtggg

SEQ ID NO: 4284 - DNA, 23 bp, Artificial
  gRNA target site sequence
ccgcggtgctgggtgggtaccgg

SEQ ID NO: 4285 - DNA, 23 bp, Artificial
  gRNA target site sequence
gggtgggtaccggcccgagctgg

SEQ ID NO: 4286 - DNA, 23 bp, Artificial
  gRNA target site sequence
ggtgggtaccggcccgagctggg

SEQ ID NO: 4287 - DNA, 23 bp, Artificial
  gRNA target site sequence
ggagcaacgcacaccggctccgg

SEQ ID NO: 4288 - DNA, 23 bp, Artificial
  gRNA target site sequence
cagcagggagcaacgcacaccgg

SEQ ID NO: 4289 - DNA, 23 bp, Artificial
  gRNA target site sequence
ggtctcctgcagccgcagcaggg

SEQ ID NO: 4290 - DNA, 23 bp, Artificial
  gRNA target site sequence
aggtctcctgcagccgcagcagg

SEQ ID NO: 4291 - DNA, 23 bp, Artificial
  gRNA target site sequence
gcagcggtccgcagcggacaagg

SEQ ID NO: 4292 - DNA, 23 bp, Artificial
  gRNA target site sequence
agcaccgcagcggtccgcagcgg

SEQ ID NO: 4293 - DNA, 23 bp, Artificial
  gRNA target site sequence
cggccagggcagcaccgcagcgg

SEQ ID NO: 4294 - DNA, 23 bp, Artificial
  gRNA target site sequence
gatcagttgatgaccggccaggg

SEQ ID NO: 4295 - DNA, 23 bp, Artificial
  gRNA target site sequence
ggatcagttgatgaccggccagg

SEQ ID NO: 4296 - DNA, 23 bp, Artificial
  gRNA target site sequence
gccgcggatcagttgatgaccgg

SEQ ID NO: 4297 - DNA, 23 bp, Artificial
  gRNA target site sequence
cgcattcctgccccaggccgcgg

SEQ ID NO: 4298 - DNA, 23 bp, Artificial
  gRNA target site sequence
tcaggacgcattcctgccccagg

SEQ ID NO: 4299 - DNA, 23 bp, Artificial
  gRNA target site sequence
gcaccgcggggctgctgctcagg

SEQ ID NO: 4300 - DNA, 23 bp, Artificial
  gRNA target site sequence
ggtacccacccagcaccgcgggg

SEQ ID NO: 4301 - DNA, 23 bp, Artificial
  gRNA target site sequence
cggtacccacccagcaccgcggg

SEQ ID NO: 4302 - DNA, 23 bp, Artificial
  gRNA target site sequence
ccggtacccacccagcaccgcgg

SEQ ID NO: 4303 - DNA, 23 bp, Artificial
  gRNA target site sequence
agcctctttcccacccaccttgg

SEQ ID NO: 4304 - DNA, 23 bp, Artificial
  gRNA target site sequence
gcctctttcccacccaccttggg

SEQ ID NO: 4305 - DNA, 23 bp, Artificial
  gRNA target site sequence
cacatattaaattttcagaatgg

SEQ ID NO: 4306 - DNA, 23 bp, Artificial
  gRNA target site sequence
aatggaaatttaagctgttccgg

SEQ ID NO: 4307 - DNA, 23 bp, Artificial
  gRNA target site sequence
atggaaatttaagctgttccggg

SEQ ID NO: 4308 - DNA, 23 bp, Artificial
  gRNA target site sequence
gacacctgaagaagctcaaaagg

SEQ ID NO: 4309 - DNA, 23 bp, Artificial
  gRNA target site sequence
agaagctcaaaaggaaaagaagg

SEQ ID NO: 4310 - DNA, 23 bp, Artificial
  gRNA target site sequence
ggaaaagaaggattcctttgagg

SEQ ID NO: 4311 - DNA, 23 bp, Artificial
  gRNA target site sequence
gaaaagaaggattcctttgaggg

SEQ ID NO: 4312 - DNA, 23 bp, Artificial
  gRNA target site sequence
aaaagaaggattcctttgagggg

SEQ ID NO: 4313 - DNA, 23 bp, Artificial
  gRNA target site sequence
ctttgaggggaaaccctctctgg

SEQ ID NO: 4314 - DNA, 23 bp, Artificial
  gRNA target site sequence
ggagcaatctccagcagtcctgg

SEQ ID NO: 4315 - DNA, 23 bp, Artificial
  gRNA target site sequence
atctccagcagtcctggacaagg

SEQ ID NO: 4316 - DNA, 23 bp, Artificial
  gRNA target site sequence
gcagtcctggacaaggctgatgg

SEQ ID NO: 4317 - DNA, 23 bp, Artificial
  gRNA target site sequence
cacgacaacgagaaagcaagagg

SEQ ID NO: 4318 - DNA, 23 bp, Artificial
  gRNA target site sequence
cgacatctctgccgcatctgtgg

SEQ ID NO: 4319 - DNA, 23 bp, Artificial
  gRNA target site sequence
gacatctctgccgcatctgtggg

SEQ ID NO: 4320 - DNA, 23 bp, Artificial
  gRNA target site sequence
ttagagctgatgagcacaacagg

SEQ ID NO: 4321 - DNA, 23 bp, Artificial
  gRNA target site sequence
aacaggagatatccagtccatgg

SEQ ID NO: 4322 - DNA, 23 bp, Artificial
  gRNA target site sequence
atatccagtccatggtcctgtgg

SEQ ID NO: 4323 - DNA, 23 bp, Artificial
  gRNA target site sequence
ccagtccatggtcctgtggatgg

SEQ ID NO: 4324 - DNA, 23 bp, Artificial
  gRNA target site sequence
cctgtggatggtaaaaccctagg

SEQ ID NO: 4325 - DNA, 23 bp, Artificial
  gRNA target site sequence
cctaggccttttacgaaagaagg

SEQ ID NO: 4326 - DNA, 23 bp, Artificial
  gRNA target site sequence
aggaaaagagagctacttcctgg

SEQ ID NO: 4327 - DNA, 23 bp, Artificial
  gRNA target site sequence
aaagagagctacttcctggccgg

SEQ ID NO: 4328 - DNA, 23 bp, Artificial
  gRNA target site sequence
ctggccggacctcattgccaagg

SEQ ID NO: 4329 - DNA, 23 bp, Artificial
  gRNA target site sequence
acctcattgccaaggttttccgg

SEQ ID NO: 4330 - DNA, 23 bp, Artificial
  gRNA target site sequence
ggttttccggatcgatgtgaagg

SEQ ID NO: 4331 - DNA, 23 bp, Artificial
  gRNA target site sequence
ctgagttctgccataactgctgg

SEQ ID NO: 4332 - DNA, 23 bp, Artificial
  gRNA target site sequence
actgctggagcatcatgcacagg

SEQ ID NO: 4333 - DNA, 23 bp, Artificial
  gRNA target site sequence
gtttagcagtgccccatgtgagg

SEQ ID NO: 4334 - DNA, 23 bp, Artificial
  gRNA target site sequence
catgtgaggtttacttcccgagg

SEQ ID NO: 4335 - DNA, 23 bp, Artificial
  gRNA target site sequence
cttcccgaggaacgtgaccatgg

SEQ ID NO: 4336 - DNA, 23 bp, Artificial
  gRNA target site sequence
cgaggaacgtgaccatggagtgg

SEQ ID NO: 4337 - DNA, 23 bp, Artificial
  gRNA target site sequence
acatctgcaacactgcccgtcgg

SEQ ID NO: 4338 - DNA, 23 bp, Artificial
  gRNA target site sequence
catctgcaacactgcccgtcggg

SEQ ID NO: 4339 - DNA, 23 bp, Artificial
  gRNA target site sequence
atctgcaacactgcccgtcgggg

SEQ ID NO: 4340 - DNA, 23 bp, Artificial
  gRNA target site sequence
ctgcccgtcggggactcaagagg

SEQ ID NO: 4341 - DNA, 23 bp, Artificial
  gRNA target site sequence
tcagcacaagagaagagctcagg

SEQ ID NO: 4342 - DNA, 23 bp, Artificial
  gRNA target site sequence
acaagagaagagctcaggcaagg

SEQ ID NO: 4343 - DNA, 23 bp, Artificial
  gRNA target site sequence
tcaggcaaggatcagcagcaagg

SEQ ID NO: 4344 - DNA, 23 bp, Artificial
  gRNA target site sequence
tagtaccaagctccttgcagtgg

SEQ ID NO: 4345 - DNA, 23 bp, Artificial
  gRNA target site sequence
ccagatctgtgaacacattctgg

SEQ ID NO: 4346 - DNA, 23 bp, Artificial
  gRNA target site sequence
acacattctggctgaccctgtgg

SEQ ID NO: 4347 - DNA, 23 bp, Artificial
  gRNA target site sequence
actgtaagcatgtcttttgccgg

SEQ ID NO: 4348 - DNA, 23 bp, Artificial
  gRNA target site sequence
ctgtaagcatgtcttttgccggg

SEQ ID NO: 4349 - DNA, 23 bp, Artificial
  gRNA target site sequence
tctcagatgcctcaaagtcatgg

SEQ ID NO: 4350 - DNA, 23 bp, Artificial
  gRNA target site sequence
ctcagatgcctcaaagtcatggg

SEQ ID NO: 4351 - DNA, 23 bp, Artificial
  gRNA target site sequence
tccatgcttccctactgacctgg

SEQ ID NO: 4352 - DNA, 23 bp, Artificial
  gRNA target site sequence
gagcgtcttgaattccctgatgg

SEQ ID NO: 4353 - DNA, 23 bp, Artificial
  gRNA target site sequence
tccagcaaaagagtgcaatgagg

SEQ ID NO: 4354 - DNA, 23 bp, Artificial
  gRNA target site sequence
agcaaaagagtgcaatgaggagg

SEQ ID NO: 4355 - DNA, 23 bp, Artificial
  gRNA target site sequence
gtgcaatgaggaggtcagtttgg

SEQ ID NO: 4356 - DNA, 23 bp, Artificial
  gRNA target site sequence
tcaccacatctcaagtcacaagg

SEQ ID NO: 4357 - DNA, 23 bp, Artificial
  gRNA target site sequence
atttttgtgcacattaataaagg

SEQ ID NO: 4358 - DNA, 23 bp, Artificial
  gRNA target site sequence
tttttgtgcacattaataaaggg

SEQ ID NO: 4359 - DNA, 23 bp, Artificial
  gRNA target site sequence
ttttgtgcacattaataaagggg

SEQ ID NO: 4360 - DNA, 23 bp, Artificial
  gRNA target site sequence
tttgtgcacattaataaaggggg

SEQ ID NO: 4361 - DNA, 23 bp, Artificial
  gRNA target site sequence
tgcacattaataaagggggccgg

SEQ ID NO: 4362 - DNA, 23 bp, Artificial
  gRNA target site sequence
aacatcttctgtcgctgactcgg

SEQ ID NO: 4363 - DNA, 23 bp, Artificial
  gRNA target site sequence
ctcggagagctcagaagcaccgg

SEQ ID NO: 4364 - DNA, 23 bp, Artificial
  gRNA target site sequence
gagctcagaagcaccggctgagg

SEQ ID NO: 4365 - DNA, 23 bp, Artificial
  gRNA target site sequence
agctcagaagcaccggctgaggg

SEQ ID NO: 4366 - DNA, 23 bp, Artificial
  gRNA target site sequence
gcctttgctgacaaagaagaagg

SEQ ID NO: 4367 - DNA, 23 bp, Artificial
  gRNA target site sequence
tttgctgacaaagaagaaggtgg

SEQ ID NO: 4368 - DNA, 23 bp, Artificial
  gRNA target site sequence
gtgcatgaccttgttcctgctgg

SEQ ID NO: 4369 - DNA, 23 bp, Artificial
  gRNA target site sequence
ccttgttcctgctggctctgagg

SEQ ID NO: 4370 - DNA, 23 bp, Artificial
  gRNA target site sequence
cttgttcctgctggctctgaggg

SEQ ID NO: 4371 - DNA, 23 bp, Artificial
  gRNA target site sequence
tcctgctggctctgagggcgagg

SEQ ID NO: 4372 - DNA, 23 bp, Artificial
  gRNA target site sequence
tgagggcgaggaatgagcacagg

SEQ ID NO: 4373 - DNA, 23 bp, Artificial
  gRNA target site sequence
gcacaggcaagctgatgagctgg

SEQ ID NO: 4374 - DNA, 23 bp, Artificial
  gRNA target site sequence
caggcaagctgatgagctggagg

SEQ ID NO: 4375 - DNA, 23 bp, Artificial
  gRNA target site sequence
tgagctggaggccatcatgcagg

SEQ ID NO: 4376 - DNA, 23 bp, Artificial
  gRNA target site sequence
gagctggaggccatcatgcaggg

SEQ ID NO: 4377 - DNA, 23 bp, Artificial
  gRNA target site sequence
ggaggccatcatgcagggaaagg

SEQ ID NO: 4378 - DNA, 23 bp, Artificial
  gRNA target site sequence
gaggccatcatgcagggaaaggg

SEQ ID NO: 4379 - DNA, 23 bp, Artificial
  gRNA target site sequence
atcatgcagggaaagggctctgg

SEQ ID NO: 4380 - DNA, 23 bp, Artificial
  gRNA target site sequence
cctgcagccagctgtttgcttgg

SEQ ID NO: 4381 - DNA, 23 bp, Artificial
  gRNA target site sequence
gtcagtaccacaagatgtacagg

SEQ ID NO: 4382 - DNA, 23 bp, Artificial
  gRNA target site sequence
aggactgtgaaagccatcacagg

SEQ ID NO: 4383 - DNA, 23 bp, Artificial
  gRNA target site sequence
ggactgtgaaagccatcacaggg

SEQ ID NO: 4384 - DNA, 23 bp, Artificial
  gRNA target site sequence
ttcagcctttgcatgcccttcgg

SEQ ID NO: 4385 - DNA, 23 bp, Artificial
  gRNA target site sequence
tgcccttcggaatgctgagaagg

SEQ ID NO: 4386 - DNA, 23 bp, Artificial
  gRNA target site sequence
gctgagaaggtacttctgccagg

SEQ ID NO: 4387 - DNA, 23 bp, Artificial
  gRNA target site sequence
caggctaccaccactttgagtgg

SEQ ID NO: 4388 - DNA, 23 bp, Artificial
  gRNA target site sequence
gtgtcttccagcactgatgttgg

SEQ ID NO: 4389 - DNA, 23 bp, Artificial
  gRNA target site sequence
actgatgttggcattattgatgg

SEQ ID NO: 4390 - DNA, 23 bp, Artificial
  gRNA target site sequence
ctgatgttggcattattgatggg

SEQ ID NO: 4391 - DNA, 23 bp, Artificial
  gRNA target site sequence
ggcattattgatgggctgtctgg

SEQ ID NO: 4392 - DNA, 23 bp, Artificial
  gRNA target site sequence
gtctggactatcatcctctgtgg

SEQ ID NO: 4393 - DNA, 23 bp, Artificial
  gRNA target site sequence
ctctgtggatgattacccagtgg

SEQ ID NO: 4394 - DNA, 23 bp, Artificial
  gRNA target site sequence
cagtggacaccattgcaaagagg

SEQ ID NO: 4395 - DNA, 23 bp, Artificial
  gRNA target site sequence
gttccgctatgattcagctttgg

SEQ ID NO: 4396 - DNA, 23 bp, Artificial
  gRNA target site sequence
agctttggtgtctgctttgatgg

SEQ ID NO: 4397 - DNA, 23 bp, Artificial
  gRNA target site sequence
ggtgtctgctttgatggacatgg

SEQ ID NO: 4398 - DNA, 23 bp, Artificial
  gRNA target site sequence
ggacatggaagaagacatcttgg

SEQ ID NO: 4399 - DNA, 23 bp, Artificial
  gRNA target site sequence
atggaagaagacatcttggaagg

SEQ ID NO: 4400 - DNA, 23 bp, Artificial
  gRNA target site sequence
gaccttgatgattacctgaatgg

SEQ ID NO: 4401 - DNA, 23 bp, Artificial
  gRNA target site sequence
cctgaatggccccttcactgtgg

SEQ ID NO: 4402 - DNA, 23 bp, Artificial
  gRNA target site sequence
gaatggccccttcactgtggtgg

SEQ ID NO: 4403 - DNA, 23 bp, Artificial
  gRNA target site sequence
ccccttcactgtggtggtgaagg

SEQ ID NO: 4404 - DNA, 23 bp, Artificial
  gRNA target site sequence
gtggtgaaggagtcttgtgatgg

SEQ ID NO: 4405 - DNA, 23 bp, Artificial
  gRNA target site sequence
gaaggagtcttgtgatggaatgg

SEQ ID NO: 4406 - DNA, 23 bp, Artificial
  gRNA target site sequence
aaggagtcttgtgatggaatggg

SEQ ID NO: 4407 - DNA, 23 bp, Artificial
  gRNA target site sequence
ggagacgtgagtgagaagcatgg

SEQ ID NO: 4408 - DNA, 23 bp, Artificial
  gRNA target site sequence
gagacgtgagtgagaagcatggg

SEQ ID NO: 4409 - DNA, 23 bp, Artificial
  gRNA target site sequence
gtgagtgagaagcatgggagtgg

SEQ ID NO: 4410 - DNA, 23 bp, Artificial
  gRNA target site sequence
tgagtgagaagcatgggagtggg

SEQ ID NO: 4411 - DNA, 23 bp, Artificial
  gRNA target site sequence
tgggcctgtagttccagaaaagg

SEQ ID NO: 4412 - DNA, 23 bp, Artificial
  gRNA target site sequence
caagccattgtgccttatgctgg

SEQ ID NO: 4413 - DNA, 23 bp, Artificial
  gRNA target site sequence
tgagtcctctcattgctgagagg

SEQ ID NO: 4414 - DNA, 23 bp, Artificial
  gRNA target site sequence
gagtcctctcattgctgagaggg

SEQ ID NO: 4415 - DNA, 23 bp, Artificial
  gRNA target site sequence
tcctctcattgctgagagggagg

SEQ ID NO: 4416 - DNA, 23 bp, Artificial
  gRNA target site sequence
cagtgaattaatgcttgagctgg

SEQ ID NO: 4417 - DNA, 23 bp, Artificial
  gRNA target site sequence
agtgaattaatgcttgagctggg

SEQ ID NO: 4418 - DNA, 23 bp, Artificial
  gRNA target site sequence
gaattaatgcttgagctgggagg

SEQ ID NO: 4419 - DNA, 23 bp, Artificial
  gRNA target site sequence
ttgagctgggaggcattctccgg

SEQ ID NO: 4420 - DNA, 23 bp, Artificial
  gRNA target site sequence
ggactttcaagttcatcttcagg

SEQ ID NO: 4421 - DNA, 23 bp, Artificial
  gRNA target site sequence
gactttcaagttcatcttcaggg

SEQ ID NO: 4422 - DNA, 23 bp, Artificial
  gRNA target site sequence
actttcaagttcatcttcagggg

SEQ ID NO: 4423 - DNA, 23 bp, Artificial
  gRNA target site sequence
aagttcatcttcaggggcaccgg

SEQ ID NO: 4424 - DNA, 23 bp, Artificial
  gRNA target site sequence
gctatgatgaaaaacttgtgcgg

SEQ ID NO: 4425 - DNA, 23 bp, Artificial
  gRNA target site sequence
ctatgatgaaaaacttgtgcggg

SEQ ID NO: 4426 - DNA, 23 bp, Artificial
  gRNA target site sequence
tgaaaaacttgtgcgggaagtgg

SEQ ID NO: 4427 - DNA, 23 bp, Artificial
  gRNA target site sequence
aaacttgtgcgggaagtggaagg

SEQ ID NO: 4428 - DNA, 23 bp, Artificial
  gRNA target site sequence
gcgggaagtggaaggcctcgagg

SEQ ID NO: 4429 - DNA, 23 bp, Artificial
  gRNA target site sequence
gtggaaggcctcgaggcttctgg

SEQ ID NO: 4430 - DNA, 23 bp, Artificial
  gRNA target site sequence
tctttgtgatgccacccgtctgg

SEQ ID NO: 4431 - DNA, 23 bp, Artificial
  gRNA target site sequence
cagaagccatgctgagaacctgg

SEQ ID NO: 4432 - DNA, 23 bp, Artificial
  gRNA target site sequence
tgagaacctggaacgttatgagg

SEQ ID NO: 4433 - DNA, 23 bp, Artificial
  gRNA target site sequence
acctggaacgttatgaggtctgg

SEQ ID NO: 4434 - DNA, 23 bp, Artificial
  gRNA target site sequence
caacccttaccatgagtctgtgg

SEQ ID NO: 4435 - DNA, 23 bp, Artificial
  gRNA target site sequence
atgagtctgtggaagaactgcgg

SEQ ID NO: 4436 - DNA, 23 bp, Artificial
  gRNA target site sequence
tgagtctgtggaagaactgcggg

SEQ ID NO: 4437 - DNA, 23 bp, Artificial
  gRNA target site sequence
ctgtggaagaactgcgggatcgg

SEQ ID NO: 4438 - DNA, 23 bp, Artificial
  gRNA target site sequence
tgtggaagaactgcgggatcggg

SEQ ID NO: 4439 - DNA, 23 bp, Artificial
  gRNA target site sequence
gaactgcgggatcgggtgaaagg

SEQ ID NO: 4440 - DNA, 23 bp, Artificial
  gRNA target site sequence
aactgcgggatcgggtgaaaggg

SEQ ID NO: 4441 - DNA, 23 bp, Artificial
  gRNA target site sequence
actgcgggatcgggtgaaagggg

SEQ ID NO: 4442 - DNA, 23 bp, Artificial
  gRNA target site sequence
gatgcactccactgtgacattgg

SEQ ID NO: 4443 - DNA, 23 bp, Artificial
  gRNA target site sequence
aagatcttccagctagagatagg

SEQ ID NO: 4444 - DNA, 23 bp, Artificial
  gRNA target site sequence
agatcttccagctagagataggg

SEQ ID NO: 4445 - DNA, 23 bp, Artificial
  gRNA target site sequence
gatcttccagctagagatagggg

SEQ ID NO: 4446 - DNA, 23 bp, Artificial
  gRNA target site sequence
gaatcccaatgcttccaaagagg

SEQ ID NO: 4447 - DNA, 23 bp, Artificial
  gRNA target site sequence
ccaatgcttccaaagaggaaagg

SEQ ID NO: 4448 - DNA, 23 bp, Artificial
  gRNA target site sequence
cttccaaagaggaaaggaaaagg

SEQ ID NO: 4449 - DNA, 23 bp, Artificial
  gRNA target site sequence
ccaaagaggaaaggaaaaggtgg

SEQ ID NO: 4450 - DNA, 23 bp, Artificial
  gRNA target site sequence
agaggaaaggaaaaggtggcagg

SEQ ID NO: 4451 - DNA, 23 bp, Artificial
  gRNA target site sequence
gaaaaggtggcaggccacactgg

SEQ ID NO: 4452 - DNA, 23 bp, Artificial
  gRNA target site sequence
ccacactggacaagcatctccgg

SEQ ID NO: 4453 - DNA, 23 bp, Artificial
  gRNA target site sequence
tgaacctcaaaccaatcatgagg

SEQ ID NO: 4454 - DNA, 23 bp, Artificial
  gRNA target site sequence
aaaccaatcatgaggatgaatgg

SEQ ID NO: 4455 - DNA, 23 bp, Artificial
  gRNA target site sequence
ggatgaatggcaactttgccagg

SEQ ID NO: 4456 - DNA, 23 bp, Artificial
  gRNA target site sequence
gctcatgaccaaagagactgtgg

SEQ ID NO: 4457 - DNA, 23 bp, Artificial
  gRNA target site sequence
ttgtgagttaattccttccgagg

SEQ ID NO: 4458 - DNA, 23 bp, Artificial
  gRNA target site sequence
agttaattccttccgaggagagg

SEQ ID NO: 4459 - DNA, 23 bp, Artificial
  gRNA target site sequence
tccttccgaggagaggcacgagg

SEQ ID NO: 4460 - DNA, 23 bp, Artificial
  gRNA target site sequence
aggagaggcacgaggctctgagg

SEQ ID NO: 4461 - DNA, 23 bp, Artificial
  gRNA target site sequence
ggagaggcacgaggctctgaggg

SEQ ID NO: 4462 - DNA, 23 bp, Artificial
  gRNA target site sequence
cgaggctctgagggagctgatgg

SEQ ID NO: 4463 - DNA, 23 bp, Artificial
  gRNA target site sequence
acctgaagatgaaaccagtatgg

SEQ ID NO: 4464 - DNA, 23 bp, Artificial
  gRNA target site sequence
tttctacgaagttcaagtatagg

SEQ ID NO: 4465 - DNA, 23 bp, Artificial
  gRNA target site sequence
gaagttcaagtataggtatgagg

SEQ ID NO: 4466 - DNA, 23 bp, Artificial
  gRNA target site sequence
aagttcaagtataggtatgaggg

SEQ ID NO: 4467 - DNA, 23 bp, Artificial
  gRNA target site sequence
caattattttcacaaaaccctgg

SEQ ID NO: 4468 - DNA, 23 bp, Artificial
  gRNA target site sequence
atgttcctgaaattattgagagg

SEQ ID NO: 4469 - DNA, 23 bp, Artificial
  gRNA target site sequence
tgttcctgaaattattgagaggg

SEQ ID NO: 4470 - DNA, 23 bp, Artificial
  gRNA target site sequence
cctgaaattattgagagggatgg

SEQ ID NO: 4471 - DNA, 23 bp, Artificial
  gRNA target site sequence
attgagagggatggctccattgg

SEQ ID NO: 4472 - DNA, 23 bp, Artificial
  gRNA target site sequence
ttgagagggatggctccattggg

SEQ ID NO: 4473 - DNA, 23 bp, Artificial
  gRNA target site sequence
tgagagggatggctccattgggg

SEQ ID NO: 4474 - DNA, 23 bp, Artificial
  gRNA target site sequence
gggatggctccattggggcatgg

SEQ ID NO: 4475 - DNA, 23 bp, Artificial
  gRNA target site sequence
ggatggctccattggggcatggg

SEQ ID NO: 4476 - DNA, 23 bp, Artificial
  gRNA target site sequence
cattggggcatgggcaagtgagg

SEQ ID NO: 4477 - DNA, 23 bp, Artificial
  gRNA target site sequence
attggggcatgggcaagtgaggg

SEQ ID NO: 4478 - DNA, 23 bp, Artificial
  gRNA target site sequence
gcaagtgagggaaatgagtctgg

SEQ ID NO: 4479 - DNA, 23 bp, Artificial
  gRNA target site sequence
agtctggtaacaaactgtttagg

SEQ ID NO: 4480 - DNA, 23 bp, Artificial
  gRNA target site sequence
acaaactgtttaggcgcttccgg

SEQ ID NO: 4481 - DNA, 23 bp, Artificial
  gRNA target site sequence
gcttccggaaaatgaatgccagg

SEQ ID NO: 4482 - DNA, 23 bp, Artificial
  gRNA target site sequence
gcagtccaaatgctatgagatgg

SEQ ID NO: 4483 - DNA, 23 bp, Artificial
  gRNA target site sequence
aagatgtcctgaaacaccactgg

SEQ ID NO: 4484 - DNA, 23 bp, Artificial
  gRNA target site sequence
cataatgcattaaaaacctctgg

SEQ ID NO: 4485 - DNA, 23 bp, Artificial
  gRNA target site sequence
ataatgcattaaaaacctctggg

SEQ ID NO: 4486 - DNA, 23 bp, Artificial
  gRNA target site sequence
tgggtttaccatgaaccctcagg

SEQ ID NO: 4487 - DNA, 23 bp, Artificial
  gRNA target site sequence
atgaaccctcaggcaagcttagg

SEQ ID NO: 4488 - DNA, 23 bp, Artificial
  gRNA target site sequence
tgaaccctcaggcaagcttaggg

SEQ ID NO: 4489 - DNA, 23 bp, Artificial
  gRNA target site sequence
gaaccctcaggcaagcttagggg

SEQ ID NO: 4490 - DNA, 23 bp, Artificial
  gRNA target site sequence
gcaagcttaggggacccattagg

SEQ ID NO: 4491 - DNA, 23 bp, Artificial
  gRNA target site sequence
aggggacccattaggcatagagg

SEQ ID NO: 4492 - DNA, 23 bp, Artificial
  gRNA target site sequence
attaggcatagaggactctctgg

SEQ ID NO: 4493 - DNA, 23 bp, Artificial
  gRNA target site sequence
tctggaaagccaagattcaatgg

SEQ ID NO: 4494 - DNA, 23 bp, Artificial
  gRNA target site sequence
tcccaaggtgggtgggaaagagg

SEQ ID NO: 4495 - DNA, 23 bp, Artificial
  gRNA target site sequence
aactgagtcccaaggtgggtggg

SEQ ID NO: 4496 - DNA, 23 bp, Artificial
  gRNA target site sequence
gaactgagtcccaaggtgggtgg

SEQ ID NO: 4497 - DNA, 23 bp, Artificial
  gRNA target site sequence
gcagaactgagtcccaaggtggg

SEQ ID NO: 4498 - DNA, 23 bp, Artificial
  gRNA target site sequence
ggcagaactgagtcccaaggtgg

SEQ ID NO: 4499 - DNA, 23 bp, Artificial
  gRNA target site sequence
tggggcagaactgagtcccaagg

SEQ ID NO: 4500 - DNA, 23 bp, Artificial
  gRNA target site sequence
tgggtgctgaatttcatctgggg

SEQ ID NO: 4501 - DNA, 23 bp, Artificial
  gRNA target site sequence
gtgggtgctgaatttcatctggg

SEQ ID NO: 4502 - DNA, 23 bp, Artificial
  gRNA target site sequence
tgtgggtgctgaatttcatctgg

SEQ ID NO: 4503 - DNA, 23 bp, Artificial
  gRNA target site sequence
attctgaaaatttaatatgtggg

SEQ ID NO: 4504 - DNA, 23 bp, Artificial
  gRNA target site sequence
cattctgaaaatttaatatgtgg

SEQ ID NO: 4505 - DNA, 23 bp, Artificial
  gRNA target site sequence
tcttttcaaaggatctcacccgg

SEQ ID NO: 4506 - DNA, 23 bp, Artificial
  gRNA target site sequence
ttcttcaggtgtcttttcaaagg

SEQ ID NO: 4507 - DNA, 23 bp, Artificial
  gRNA target site sequence
ttttccttttgagcttcttcagg

SEQ ID NO: 4508 - DNA, 23 bp, Artificial
  gRNA target site sequence
cagagagggtttcccctcaaagg

SEQ ID NO: 4509 - DNA, 23 bp, Artificial
  gRNA target site sequence
gctggagattgctccagagaggg

SEQ ID NO: 4510 - DNA, 23 bp, Artificial
  gRNA target site sequence
tgctggagattgctccagagagg

SEQ ID NO: 4511 - DNA, 23 bp, Artificial
  gRNA target site sequence
tcagccttgtccaggactgctgg

SEQ ID NO: 4512 - DNA, 23 bp, Artificial
  gRNA target site sequence
tctgaccatcagccttgtccagg

SEQ ID NO: 4513 - DNA, 23 bp, Artificial
  gRNA target site sequence
aacaatggctgagttgggactgg

SEQ ID NO: 4514 - DNA, 23 bp, Artificial
  gRNA target site sequence
cttttaacaatggctgagttggg

SEQ ID NO: 4515 - DNA, 23 bp, Artificial
  gRNA target site sequence
gcttttaacaatggctgagttgg

SEQ ID NO: 4516 - DNA, 23 bp, Artificial
  gRNA target site sequence
ttagggtgggcttttaacaatgg

SEQ ID NO: 4517 - DNA, 23 bp, Artificial
  gRNA target site sequence
tttctttgaaaacttagggtggg

SEQ ID NO: 4518 - DNA, 23 bp, Artificial
  gRNA target site sequence
atttctttgaaaacttagggtgg

SEQ ID NO: 4519 - DNA, 23 bp, Artificial
  gRNA target site sequence
gaaatttctttgaaaacttaggg

SEQ ID NO: 4520 - DNA, 23 bp, Artificial
  gRNA target site sequence
tgaaatttctttgaaaacttagg

SEQ ID NO: 4521 - DNA, 23 bp, Artificial
  gRNA target site sequence
gatgtcgaaggttggcttgatgg

SEQ ID NO: 4522 - DNA, 23 bp, Artificial
  gRNA target site sequence
gcggcagagatgtcgaaggttgg

SEQ ID NO: 4523 - DNA, 23 bp, Artificial
  gRNA target site sequence
agatgcggcagagatgtcgaagg

SEQ ID NO: 4524 - DNA, 23 bp, Artificial
  gRNA target site sequence
taaaagaattcccacagatgcgg

SEQ ID NO: 4525 - DNA, 23 bp, Artificial
  gRNA target site sequence
ccatccacaggaccatggactgg

SEQ ID NO: 4526 - DNA, 23 bp, Artificial
  gRNA target site sequence
ttttaccatccacaggaccatgg

SEQ ID NO: 4527 - DNA, 23 bp, Artificial
  gRNA target site sequence
cctagggttttaccatccacagg

SEQ ID NO: 4528 - DNA, 23 bp, Artificial
  gRNA target site sequence
cttctttcgtaaaaggcctaggg

SEQ ID NO: 4529 - DNA, 23 bp, Artificial
  gRNA target site sequence
ccttctttcgtaaaaggcctagg

SEQ ID NO: 4530 - DNA, 23 bp, Artificial
  gRNA target site sequence
tcttttccttctttcgtaaaagg

SEQ ID NO: 4531 - DNA, 23 bp, Artificial
  gRNA target site sequence
cttggcaatgaggtccggccagg

SEQ ID NO: 4532 - DNA, 23 bp, Artificial
  gRNA target site sequence
aaaaccttggcaatgaggtccgg

SEQ ID NO: 4533 - DNA, 23 bp, Artificial
  gRNA target site sequence
tccggaaaaccttggcaatgagg

SEQ ID NO: 4534 - DNA, 23 bp, Artificial
  gRNA target site sequence
cacatcgatccggaaaaccttgg

SEQ ID NO: 4535 - DNA, 23 bp, Artificial
  gRNA target site sequence
catctgccttcacatcgatccgg

SEQ ID NO: 4536 - DNA, 23 bp, Artificial
  gRNA target site sequence
tatggcagaactcagtggggtgg

SEQ ID NO: 4537 - DNA, 23 bp, Artificial
  gRNA target site sequence
agttatggcagaactcagtgggg

SEQ ID NO: 4538 - DNA, 23 bp, Artificial
  gRNA target site sequence
cagttatggcagaactcagtggg

SEQ ID NO: 4539 - DNA, 23 bp, Artificial
  gRNA target site sequence
gcagttatggcagaactcagtgg

SEQ ID NO: 4540 - DNA, 23 bp, Artificial
  gRNA target site sequence
gcatgatgctccagcagttatgg

SEQ ID NO: 4541 - DNA, 23 bp, Artificial
  gRNA target site sequence
cgggaagtaaacctcacatgggg

SEQ ID NO: 4542 - DNA, 23 bp, Artificial
  gRNA target site sequence
tcgggaagtaaacctcacatggg

SEQ ID NO: 4543 - DNA, 23 bp, Artificial
  gRNA target site sequence
ctcgggaagtaaacctcacatgg

SEQ ID NO: 4544 - DNA, 23 bp, Artificial
  gRNA target site sequence
actccatggtcacgttcctcggg

SEQ ID NO: 4545 - DNA, 23 bp, Artificial
  gRNA target site sequence
cactccatggtcacgttcctcgg

SEQ ID NO: 4546 - DNA, 23 bp, Artificial
  gRNA target site sequence
tgtgtgggggtgccactccatgg

SEQ ID NO: 4547 - DNA, 23 bp, Artificial
  gRNA target site sequence
tgtcacaggatggtgtgtggggg

SEQ ID NO: 4548 - DNA, 23 bp, Artificial
  gRNA target site sequence
atgtcacaggatggtgtgtgggg

SEQ ID NO: 4549 - DNA, 23 bp, Artificial
  gRNA target site sequence
gatgtcacaggatggtgtgtggg

SEQ ID NO: 4550 - DNA, 23 bp, Artificial
  gRNA target site sequence
agatgtcacaggatggtgtgtgg

SEQ ID NO: 4551 - DNA, 23 bp, Artificial
  gRNA target site sequence
gtgttgcagatgtcacaggatgg

SEQ ID NO: 4552 - DNA, 23 bp, Artificial
  gRNA target site sequence
ggcagtgttgcagatgtcacagg

SEQ ID NO: 4553 - DNA, 23 bp, Artificial
  gRNA target site sequence
cttcctcttgagtccccgacggg

SEQ ID NO: 4554 - DNA, 23 bp, Artificial
  gRNA target site sequence
tcttcctcttgagtccccgacgg

SEQ ID NO: 4555 - DNA, 23 bp, Artificial
  gRNA target site sequence
tttttgctgagctgcaagtttgg

SEQ ID NO: 4556 - DNA, 23 bp, Artificial
  gRNA target site sequence
gctgacgggcttgtcttgcttgg

SEQ ID NO: 4557 - DNA, 23 bp, Artificial
  gRNA target site sequence
agctcttctcttgtgctgacggg

SEQ ID NO: 4558 - DNA, 23 bp, Artificial
  gRNA target site sequence
gagctcttctcttgtgctgacgg

SEQ ID NO: 4559 - DNA, 23 bp, Artificial
  gRNA target site sequence
aagatgtatcttactgcagttgg

SEQ ID NO: 4560 - DNA, 23 bp, Artificial
  gRNA target site sequence
gaagtccactgcaaggagcttgg

SEQ ID NO: 4561 - DNA, 23 bp, Artificial
  gRNA target site sequence
gctctgggaagtccactgcaagg

SEQ ID NO: 4562 - DNA, 23 bp, Artificial
  gRNA target site sequence
tggatttcacaaagtgctctggg

SEQ ID NO: 4563 - DNA, 23 bp, Artificial
  gRNA target site sequence
atggatttcacaaagtgctctgg

SEQ ID NO: 4564 - DNA, 23 bp, Artificial
  gRNA target site sequence
ttcacagatctggcaggagatgg

SEQ ID NO: 4565 - DNA, 23 bp, Artificial
  gRNA target site sequence
aatgtgttcacagatctggcagg

SEQ ID NO: 4566 - DNA, 23 bp, Artificial
  gRNA target site sequence
ccagaatgtgttcacagatctgg

SEQ ID NO: 4567 - DNA, 23 bp, Artificial
  gRNA target site sequence
gcttacagttggtctccacaggg

SEQ ID NO: 4568 - DNA, 23 bp, Artificial
  gRNA target site sequence
tgcttacagttggtctccacagg

SEQ ID NO: 4569 - DNA, 23 bp, Artificial
  gRNA target site sequence
gcaaaagacatgcttacagttgg

SEQ ID NO: 4570 - DNA, 23 bp, Artificial
  gRNA target site sequence
ggcatctgagaatgcagacccgg

SEQ ID NO: 4571 - DNA, 23 bp, Artificial
  gRNA target site sequence
aatagctgcccatgactttgagg

SEQ ID NO: 4572 - DNA, 23 bp, Artificial
  gRNA target site sequence
aagcatggatatcggcaagaggg

SEQ ID NO: 4573 - DNA, 23 bp, Artificial
  gRNA target site sequence
gaagcatggatatcggcaagagg

SEQ ID NO: 4574 - DNA, 23 bp, Artificial
  gRNA target site sequence
cagtagggaagcatggatatcgg

SEQ ID NO: 4575 - DNA, 23 bp, Artificial
  gRNA target site sequence
tccaggtcagtagggaagcatgg

SEQ ID NO: 4576 - DNA, 23 bp, Artificial
  gRNA target site sequence
ctggactctccaggtcagtaggg

SEQ ID NO: 4577 - DNA, 23 bp, Artificial
  gRNA target site sequence
actggactctccaggtcagtagg

SEQ ID NO: 4578 - DNA, 23 bp, Artificial
  gRNA target site sequence
aggacttcactggactctccagg

SEQ ID NO: 4579 - DNA, 23 bp, Artificial
  gRNA target site sequence
acgctcagaaaggacttcactgg

SEQ ID NO: 4580 - DNA, 23 bp, Artificial
  gRNA target site sequence
ggaattcaagacgctcagaaagg

SEQ ID NO: 4581 - DNA, 23 bp, Artificial
  gRNA target site sequence
tgctggacatttcaccatcaggg

SEQ ID NO: 4582 - DNA, 23 bp, Artificial
  gRNA target site sequence
ttgctggacatttcaccatcagg

SEQ ID NO: 4583 - DNA, 23 bp, Artificial
  gRNA target site sequence
tcctcattgcactcttttgctgg

SEQ ID NO: 4584 - DNA, 23 bp, Artificial
  gRNA target site sequence
attccttgtgacttgagatgtgg

SEQ ID NO: 4585 - DNA, 23 bp, Artificial
  gRNA target site sequence
acagaagatgttggcggggccgg

SEQ ID NO: 4586 - DNA, 23 bp, Artificial
  gRNA target site sequence
agcgacagaagatgttggcgggg

SEQ ID NO: 4587 - DNA, 23 bp, Artificial
  gRNA target site sequence
cagcgacagaagatgttggcggg

SEQ ID NO: 4588 - DNA, 23 bp, Artificial
  gRNA target site sequence
tcagcgacagaagatgttggcgg

SEQ ID NO: 4589 - DNA, 23 bp, Artificial
  gRNA target site sequence
gagtcagcgacagaagatgttgg

SEQ ID NO: 4590 - DNA, 23 bp, Artificial
  gRNA target site sequence
gcagcttgagctccctcagccgg

SEQ ID NO: 4591 - DNA, 23 bp, Artificial
  gRNA target site sequence
accttcttctttgtcagcaaagg

SEQ ID NO: 4592 - DNA, 23 bp, Artificial
  gRNA target site sequence
caggaacaaggtcatgcacacgg

SEQ ID NO: 4593 - DNA, 23 bp, Artificial
  gRNA target site sequence
cctcagagccagcaggaacaagg

SEQ ID NO: 4594 - DNA, 23 bp, Artificial
  gRNA target site sequence
tcctcgccctcagagccagcagg

SEQ ID NO: 4595 - DNA, 23 bp, Artificial
  gRNA target site sequence
agagccctttccctgcatgatgg

SEQ ID NO: 4596 - DNA, 23 bp, Artificial
  gRNA target site sequence
ccaagcaaacagctggctgcagg

SEQ ID NO: 4597 - DNA, 23 bp, Artificial
  gRNA target site sequence
cggatggccaagcaaacagctgg

SEQ ID NO: 4598 - DNA, 23 bp, Artificial
  gRNA target site sequence
gaggaaggtgttgacacggatgg

SEQ ID NO: 4599 - DNA, 23 bp, Artificial
  gRNA target site sequence
agctgaggaaggtgttgacacgg

SEQ ID NO: 4600 - DNA, 23 bp, Artificial
  gRNA target site sequence
gtactgactgcagctgaggaagg

SEQ ID NO: 4601 - DNA, 23 bp, Artificial
  gRNA target site sequence
tgtggtactgactgcagctgagg

SEQ ID NO: 4602 - DNA, 23 bp, Artificial
  gRNA target site sequence
tcacagtcctgtacatcttgtgg

SEQ ID NO: 4603 - DNA, 23 bp, Artificial
  gRNA target site sequence
aaaaatctgtctccctgtgatgg

SEQ ID NO: 4604 - DNA, 23 bp, Artificial
  gRNA target site sequence
gcattccgaagggcatgcaaagg

SEQ ID NO: 4605 - DNA, 23 bp, Artificial
  gRNA target site sequence
taccttctcagcattccgaaggg

SEQ ID NO: 4606 - DNA, 23 bp, Artificial
  gRNA target site sequence
gtaccttctcagcattccgaagg

SEQ ID NO: 4607 - DNA, 23 bp, Artificial
  gRNA target site sequence
cactcaaagtggtggtagcctgg

SEQ ID NO: 4608 - DNA, 23 bp, Artificial
  gRNA target site sequence
gtggctgccactcaaagtggtgg

SEQ ID NO: 4609 - DNA, 23 bp, Artificial
  gRNA target site sequence
gaggtggctgccactcaaagtgg

SEQ ID NO: 4610 - DNA, 23 bp, Artificial
  gRNA target site sequence
gaagacacattcttcagaggtgg

SEQ ID NO: 4611 - DNA, 23 bp, Artificial
  gRNA target site sequence
ctggaagacacattcttcagagg

SEQ ID NO: 4612 - DNA, 23 bp, Artificial
  gRNA target site sequence
aataatgccaacatcagtgctgg

SEQ ID NO: 4613 - DNA, 23 bp, Artificial
  gRNA target site sequence
cactgggtaatcatccacagagg

SEQ ID NO: 4614 - DNA, 23 bp, Artificial
  gRNA target site sequence
tctttgcaatggtgtccactggg

SEQ ID NO: 4615 - DNA, 23 bp, Artificial
  gRNA target site sequence
ctctttgcaatggtgtccactgg

SEQ ID NO: 4616 - DNA, 23 bp, Artificial
  gRNA target site sequence
atagcggaacctctttgcaatgg

SEQ ID NO: 4617 - DNA, 23 bp, Artificial
  gRNA target site sequence
acaccaaagctgaatcatagcgg

SEQ ID NO: 4618 - DNA, 23 bp, Artificial
  gRNA target site sequence
caggtaatcatcaaggtcttggg

SEQ ID NO: 4619 - DNA, 23 bp, Artificial
  gRNA target site sequence
tcaggtaatcatcaaggtcttgg

SEQ ID NO: 4620 - DNA, 23 bp, Artificial
  gRNA target site sequence
ggccattcaggtaatcatcaagg

SEQ ID NO: 4621 - DNA, 23 bp, Artificial
  gRNA target site sequence
ccacagtgaaggggccattcagg

SEQ ID NO: 4622 - DNA, 23 bp, Artificial
  gRNA target site sequence
ccttcaccaccacagtgaagggg

SEQ ID NO: 4623 - DNA, 23 bp, Artificial
  gRNA target site sequence
tccttcaccaccacagtgaaggg

SEQ ID NO: 4624 - DNA, 23 bp, Artificial
  gRNA target site sequence
ctccttcaccaccacagtgaagg

SEQ ID NO: 4625 - DNA, 23 bp, Artificial
  gRNA target site sequence
actgccttttctggaactacagg

SEQ ID NO: 4626 - DNA, 23 bp, Artificial
  gRNA target site sequence
gaaaaacggactgccttttctgg

SEQ ID NO: 4627 - DNA, 23 bp, Artificial
  gRNA target site sequence
tcatgattgtgaatgaaaaacgg

SEQ ID NO: 4628 - DNA, 23 bp, Artificial
  gRNA target site sequence
tttcacattctgagagctgtggg

SEQ ID NO: 4629 - DNA, 23 bp, Artificial
  gRNA target site sequence
ctttcacattctgagagctgtgg

SEQ ID NO: 4630 - DNA, 23 bp, Artificial
  gRNA target site sequence
acacagttcagagttaggtttgg

SEQ ID NO: 4631 - DNA, 23 bp, Artificial
  gRNA target site sequence
ttgcaacacagttcagagttagg

SEQ ID NO: 4632 - DNA, 23 bp, Artificial
  gRNA target site sequence
tctgccagcataaggcacaatgg

SEQ ID NO: 4633 - DNA, 23 bp, Artificial
  gRNA target site sequence
cagactcatctgccagcataagg

SEQ ID NO: 4634 - DNA, 23 bp, Artificial
  gRNA target site sequence
ggatggcagtcagcgtctcgtgg

SEQ ID NO: 4635 - DNA, 23 bp, Artificial
  gRNA target site sequence
agcaatgagaggactcaggatgg

SEQ ID NO: 4636 - DNA, 23 bp, Artificial
  gRNA target site sequence
tctcagcaatgagaggactcagg

SEQ ID NO: 4637 - DNA, 23 bp, Artificial
  gRNA target site sequence
gcctccctctcagcaatgagagg

SEQ ID NO: 4638 - DNA, 23 bp, Artificial
  gRNA target site sequence
cattaattcactgctcttcatgg

SEQ ID NO: 4639 - DNA, 23 bp, Artificial
  gRNA target site sequence
tgaagatgaacttgaaagtccgg

SEQ ID NO: 4640 - DNA, 23 bp, Artificial
  gRNA target site sequence
cacaagtttttcatcatagccgg

SEQ ID NO: 4641 - DNA, 23 bp, Artificial
  gRNA target site sequence
agactgagccagaagcctcgagg

SEQ ID NO: 4642 - DNA, 23 bp, Artificial
  gRNA target site sequence
ttgagaggcttccagacgggtgg

SEQ ID NO: 4643 - DNA, 23 bp, Artificial
  gRNA target site sequence
attttgagaggcttccagacggg

SEQ ID NO: 4644 - DNA, 23 bp, Artificial
  gRNA target site sequence
gattttgagaggcttccagacgg

SEQ ID NO: 4645 - DNA, 23 bp, Artificial
  gRNA target site sequence
gtggaagacaagattttgagagg

SEQ ID NO: 4646 - DNA, 23 bp, Artificial
  gRNA target site sequence
catggcttctggttatagagtgg

SEQ ID NO: 4647 - DNA, 23 bp, Artificial
  gRNA target site sequence
caggttctcagcatggcttctgg

SEQ ID NO: 4648 - DNA, 23 bp, Artificial
  gRNA target site sequence
aacgttccaggttctcagcatgg

SEQ ID NO: 4649 - DNA, 23 bp, Artificial
  gRNA target site sequence
gccagacctcataacgttccagg

SEQ ID NO: 4650 - DNA, 23 bp, Artificial
  gRNA target site sequence
cacagactcatggtaagggttgg

SEQ ID NO: 4651 - DNA, 23 bp, Artificial
  gRNA target site sequence
cttccacagactcatggtaaggg

SEQ ID NO: 4652 - DNA, 23 bp, Artificial
  gRNA target site sequence
tcttccacagactcatggtaagg

SEQ ID NO: 4653 - DNA, 23 bp, Artificial
  gRNA target site sequence
gcagttcttccacagactcatgg

SEQ ID NO: 4654 - DNA, 23 bp, Artificial
  gRNA target site sequence
gaagggactgtctcaatgaaagg

SEQ ID NO: 4655 - DNA, 23 bp, Artificial
  gRNA target site sequence
agtggagtgcatctatggaaggg

SEQ ID NO: 4656 - DNA, 23 bp, Artificial
  gRNA target site sequence
cagtggagtgcatctatggaagg

SEQ ID NO: 4657 - DNA, 23 bp, Artificial
  gRNA target site sequence
gtcacagtggagtgcatctatgg

SEQ ID NO: 4658 - DNA, 23 bp, Artificial
  gRNA target site sequence
ctgcattgccaatgtcacagtgg

SEQ ID NO: 4659 - DNA, 23 bp, Artificial
  gRNA target site sequence
acacttcccctatctctagctgg

SEQ ID NO: 4660 - DNA, 23 bp, Artificial
  gRNA target site sequence
ctttcctctttggaagcattggg

SEQ ID NO: 4661 - DNA, 23 bp, Artificial
  gRNA target site sequence
cctttcctctttggaagcattgg

SEQ ID NO: 4662 - DNA, 23 bp, Artificial
  gRNA target site sequence
ccaccttttcctttcctctttgg

SEQ ID NO: 4663 - DNA, 23 bp, Artificial
  gRNA target site sequence
ccggagatgcttgtccagtgtgg

SEQ ID NO: 4664 - DNA, 23 bp, Artificial
  gRNA target site sequence
gtttgaggttcatcttcttccgg

SEQ ID NO: 4665 - DNA, 23 bp, Artificial
  gRNA target site sequence
tcatcctcatgattggtttgagg

SEQ ID NO: 4666 - DNA, 23 bp, Artificial
  gRNA target site sequence
ttgccattcatcctcatgattgg

SEQ ID NO: 4667 - DNA, 23 bp, Artificial
  gRNA target site sequence
ctctttggtcatgagcttcctgg

SEQ ID NO: 4668 - DNA, 23 bp, Artificial
  gRNA target site sequence
aactgcatccacagtctctttgg

SEQ ID NO: 4669 - DNA, 23 bp, Artificial
  gRNA target site sequence
gcctcgtgcctctcctcggaagg

SEQ ID NO: 4670 - DNA, 23 bp, Artificial
  gRNA target site sequence
cagagcctcgtgcctctcctcgg

SEQ ID NO: 4671 - DNA, 23 bp, Artificial
  gRNA target site sequence
gccatactggtttcatcttcagg

SEQ ID NO: 4672 - DNA, 23 bp, Artificial
  gRNA target site sequence
gggcatgatgatcgccatactgg

SEQ ID NO: 4673 - DNA, 23 bp, Artificial
  gRNA target site sequence
attctgggcactctttagcaggg

SEQ ID NO: 4674 - DNA, 23 bp, Artificial
  gRNA target site sequence
gattctgggcactctttagcagg

SEQ ID NO: 4675 - DNA, 23 bp, Artificial
  gRNA target site sequence
tgtactggcagagggattctggg

SEQ ID NO: 4676 - DNA, 23 bp, Artificial
  gRNA target site sequence
ctgtactggcagagggattctgg

SEQ ID NO: 4677 - DNA, 23 bp, Artificial
  gRNA target site sequence
attgaaactgtactggcagaggg

SEQ ID NO: 4678 - DNA, 23 bp, Artificial
  gRNA target site sequence
aattgaaactgtactggcagagg

SEQ ID NO: 4679 - DNA, 23 bp, Artificial
  gRNA target site sequence
gctgtgaattgaaactgtactgg

SEQ ID NO: 4680 - DNA, 23 bp, Artificial
  gRNA target site sequence
tatacttgaacttcgtagaaagg

SEQ ID NO: 4681 - DNA, 23 bp, Artificial
  gRNA target site sequence
cagggttttgtgaaaataattgg

SEQ ID NO: 4682 - DNA, 23 bp, Artificial
  gRNA target site sequence
aatttcaggaacatgggccaggg

SEQ ID NO: 4683 - DNA, 23 bp, Artificial
  gRNA target site sequence
taatttcaggaacatgggccagg

SEQ ID NO: 4684 - DNA, 23 bp, Artificial
  gRNA target site sequence
ctcaataatttcaggaacatggg

SEQ ID NO: 4685 - DNA, 23 bp, Artificial
  gRNA target site sequence
tctcaataatttcaggaacatgg

SEQ ID NO: 4686 - DNA, 23 bp, Artificial
  gRNA target site sequence
ccatccctctcaataatttcagg

SEQ ID NO: 4687 - DNA, 23 bp, Artificial
  gRNA target site sequence
ctcacttgcccatgccccaatgg

SEQ ID NO: 4688 - DNA, 23 bp, Artificial
  gRNA target site sequence
actgcctggcattcattttccgg

SEQ ID NO: 4689 - DNA, 23 bp, Artificial
  gRNA target site sequence
ctcatagcatttggactgcctgg

SEQ ID NO: 4690 - DNA, 23 bp, Artificial
  gRNA target site sequence
atcttccatctcatagcatttgg

SEQ ID NO: 4691 - DNA, 23 bp, Artificial
  gRNA target site sequence
tgtacaaccagtggtgtttcagg

SEQ ID NO: 4692 - DNA, 23 bp, Artificial
  gRNA target site sequence
atttggaggtgtacaaccagtgg

SEQ ID NO: 4693 - DNA, 23 bp, Artificial
  gRNA target site sequence
aaacttctggaggtatttggagg

SEQ ID NO: 4694 - DNA, 23 bp, Artificial
  gRNA target site sequence
cataaacttctggaggtatttgg

SEQ ID NO: 4695 - DNA, 23 bp, Artificial
  gRNA target site sequence
gagcattcataaacttctggagg

SEQ ID NO: 4696 - DNA, 23 bp, Artificial
  gRNA target site sequence
tatgagcattcataaacttctgg

SEQ ID NO: 4697 - DNA, 23 bp, Artificial
  gRNA target site sequence
agggttcatggtaaacccagagg

SEQ ID NO: 4698 - DNA, 23 bp, Artificial
  gRNA target site sequence
taagcttgcctgagggttcatgg

SEQ ID NO: 4699 - DNA, 23 bp, Artificial
  gRNA target site sequence
ggtcccctaagcttgcctgaggg

SEQ ID NO: 4700 - DNA, 23 bp, Artificial
  gRNA target site sequence
gggtcccctaagcttgcctgagg

SEQ ID NO: 4701 - DNA, 23 bp, Artificial
  gRNA target site sequence
gagagtcctctatgcctaatggg

SEQ ID NO: 4702 - DNA, 23 bp, Artificial
  gRNA target site sequence
agagagtcctctatgcctaatgg

SEQ ID NO: 4703 - DNA, 23 bp, Artificial
  gRNA target site sequence
aacatagccttaattcagccagg

SEQ ID NO: 4704 - DNA, 23 bp, Artificial
  gRNA target site sequence
ttctcactgatgaattttgatgg

SEQ ID NO: 4705 - DNA, 23 bp, Artificial
  gRNA target site sequence
gatggacaagttttcttctttgg

SEQ ID NO: 4706 - DNA, 23 bp, Artificial
  gRNA target site sequence
gttttcttctttggacaaaaagg

SEQ ID NO: 4707 - DNA, 23 bp, Artificial
  gRNA target site sequence
tcttctttggacaaaaaggctgg

SEQ ID NO: 4708 - DNA, 23 bp, Artificial
  gRNA target site sequence
cccaaaagatcctgccccactgg

SEQ ID NO: 4709 - DNA, 23 bp, Artificial
  gRNA target site sequence
ccccactggagttttccatctgg

SEQ ID NO: 4710 - DNA, 23 bp, Artificial
  gRNA target site sequence
gaagcctacaattttctctaagg

SEQ ID NO: 4711 - DNA, 23 bp, Artificial
  gRNA target site sequence
ccagccacttgcacattcaaagg

SEQ ID NO: 4712 - DNA, 23 bp, Artificial
  gRNA target site sequence
ttgcacattcaaaggcagcttgg

SEQ ID NO: 4713 - DNA, 23 bp, Artificial
  gRNA target site sequence
aagcatcaatacatcatccatgg

SEQ ID NO: 4714 - DNA, 23 bp, Artificial
  gRNA target site sequence
catcaatacatcatccatggagg

SEQ ID NO: 4715 - DNA, 23 bp, Artificial
  gRNA target site sequence
atcaatacatcatccatggaggg

SEQ ID NO: 4716 - DNA, 23 bp, Artificial
  gRNA target site sequence
agggaaaacaccaaacaatgagg

SEQ ID NO: 4717 - DNA, 23 bp, Artificial
  gRNA target site sequence
tgtttgcaagaacaacaaaaagg

SEQ ID NO: 4718 - DNA, 23 bp, Artificial
  gRNA target site sequence
tcgctgcacagagaaagacttgg

SEQ ID NO: 4719 - DNA, 23 bp, Artificial
  gRNA target site sequence
tgcacagagaaagacttggtagg

SEQ ID NO: 4720 - DNA, 23 bp, Artificial
  gRNA target site sequence
gatgttcctgaagccagatatgg

SEQ ID NO: 4721 - DNA, 23 bp, Artificial
  gRNA target site sequence
atatggtcattccattaatgtgg

SEQ ID NO: 4722 - DNA, 23 bp, Artificial
  gRNA target site sequence
attaatgtggtgtacagccgagg

SEQ ID NO: 4723 - DNA, 23 bp, Artificial
  gRNA target site sequence
ttaatgtggtgtacagccgaggg

SEQ ID NO: 4724 - DNA, 23 bp, Artificial
  gRNA target site sequence
gtacagccgagggaaaagtatgg

SEQ ID NO: 4725 - DNA, 23 bp, Artificial
  gRNA target site sequence
tacagccgagggaaaagtatggg

SEQ ID NO: 4726 - DNA, 23 bp, Artificial
  gRNA target site sequence
aaaagtatgggtgttctctttgg

SEQ ID NO: 4727 - DNA, 23 bp, Artificial
  gRNA target site sequence
agtatgggtgttctctttggagg

SEQ ID NO: 4728 - DNA, 23 bp, Artificial
  gRNA target site sequence
cccacagaaccacagaaaaatgg

SEQ ID NO: 4729 - DNA, 23 bp, Artificial
  gRNA target site sequence
ctgcctgccctgtgttttcctgg

SEQ ID NO: 4730 - DNA, 23 bp, Artificial
  gRNA target site sequence
cctgccctgtgttttcctggtgg

SEQ ID NO: 4731 - DNA, 23 bp, Artificial
  gRNA target site sequence
ttcctggtggattttgaatttgg

SEQ ID NO: 4732 - DNA, 23 bp, Artificial
  gRNA target site sequence
tcctggtggattttgaatttggg

SEQ ID NO: 4733 - DNA, 23 bp, Artificial
  gRNA target site sequence
atacattcttccagaacttcagg

SEQ ID NO: 4734 - DNA, 23 bp, Artificial
  gRNA target site sequence
attcttccagaacttcaggatgg

SEQ ID NO: 4735 - DNA, 23 bp, Artificial
  gRNA target site sequence
ttcttccagaacttcaggatggg

SEQ ID NO: 4736 - DNA, 23 bp, Artificial
  gRNA target site sequence
aatgacaccatctatattttagg

SEQ ID NO: 4737 - DNA, 23 bp, Artificial
  gRNA target site sequence
gacaccatctatattttaggagg

SEQ ID NO: 4738 - DNA, 23 bp, Artificial
  gRNA target site sequence
attcacttgccaataatatccgg

SEQ ID NO: 4739 - DNA, 23 bp, Artificial
  gRNA target site sequence
ctgccaacctgtacagaataagg

SEQ ID NO: 4740 - DNA, 23 bp, Artificial
  gRNA target site sequence
tgccaacctgtacagaataaggg

SEQ ID NO: 4741 - DNA, 23 bp, Artificial
  gRNA target site sequence
aataagggttgatcttcccctgg

SEQ ID NO: 4742 - DNA, 23 bp, Artificial
  gRNA target site sequence
ataagggttgatcttcccctggg

SEQ ID NO: 4743 - DNA, 23 bp, Artificial
  gRNA target site sequence
gtgaattgcacagtcttgccagg

SEQ ID NO: 4744 - DNA, 23 bp, Artificial
  gRNA target site sequence
aattgcacagtcttgccaggagg

SEQ ID NO: 4745 - DNA, 23 bp, Artificial
  gRNA target site sequence
aatgatgaatttgttattgttgg

SEQ ID NO: 4746 - DNA, 23 bp, Artificial
  gRNA target site sequence
gatgaatttgttattgttggtgg

SEQ ID NO: 4747 - DNA, 23 bp, Artificial
  gRNA target site sequence
ctgcaacatcatctctttagagg

SEQ ID NO: 4748 - DNA, 23 bp, Artificial
  gRNA target site sequence
caagatagaaattcgtgagatgg

SEQ ID NO: 4749 - DNA, 23 bp, Artificial
  gRNA target site sequence
gtgagatggagaccccagattgg

SEQ ID NO: 4750 - DNA, 23 bp, Artificial
  gRNA target site sequence
acattaagcacagcaagatatgg

SEQ ID NO: 4751 - DNA, 23 bp, Artificial
  gRNA target site sequence
aagcacagcaagatatggtttgg

SEQ ID NO: 4752 - DNA, 23 bp, Artificial
  gRNA target site sequence
gatatggtttggaagcaacatgg

SEQ ID NO: 4753 - DNA, 23 bp, Artificial
  gRNA target site sequence
atatggtttggaagcaacatggg

SEQ ID NO: 4754 - DNA, 23 bp, Artificial
  gRNA target site sequence
tttggaagcaacatgggaaatgg

SEQ ID NO: 4755 - DNA, 23 bp, Artificial
  gRNA target site sequence
ggaaatggaactgtttttcttgg

SEQ ID NO: 4756 - DNA, 23 bp, Artificial
  gRNA target site sequence
actgtttttcttggcataccagg

SEQ ID NO: 4757 - DNA, 23 bp, Artificial
  gRNA target site sequence
aataaacaagttgtttcagaagg

SEQ ID NO: 4758 - DNA, 23 bp, Artificial
  gRNA target site sequence
caaacatcaacagaagatccagg

SEQ ID NO: 4759 - DNA, 23 bp, Artificial
  gRNA target site sequence
aaacatcaacagaagatccaggg

SEQ ID NO: 4760 - DNA, 23 bp, Artificial
  gRNA target site sequence
aacatcaacagaagatccagggg

SEQ ID NO: 4761 - DNA, 23 bp, Artificial
  gRNA target site sequence
gcagaagcaaatagttttgatgg

SEQ ID NO: 4762 - DNA, 23 bp, Artificial
  gRNA target site sequence
gaagaagatgagtctgagacagg

SEQ ID NO: 4763 - DNA, 23 bp, Artificial
  gRNA target site sequence
atgagtctgagacaggctactgg

SEQ ID NO: 4764 - DNA, 23 bp, Artificial
  gRNA target site sequence
atgctgccctacttgtgatgtgg

SEQ ID NO: 4765 - DNA, 23 bp, Artificial
  gRNA target site sequence
gtgatgtggatatcaacacttgg

SEQ ID NO: 4766 - DNA, 23 bp, Artificial
  gRNA target site sequence
tgatgtggatatcaacacttggg

SEQ ID NO: 4767 - DNA, 23 bp, Artificial
  gRNA target site sequence
gccatgatctactgctctcatgg

SEQ ID NO: 4768 - DNA, 23 bp, Artificial
  gRNA target site sequence
ccatgatctactgctctcatggg

SEQ ID NO: 4769 - DNA, 23 bp, Artificial
  gRNA target site sequence
catgatctactgctctcatgggg

SEQ ID NO: 4770 - DNA, 23 bp, Artificial
  gRNA target site sequence
atctactgctctcatggggatgg

SEQ ID NO: 4771 - DNA, 23 bp, Artificial
  gRNA target site sequence
tctactgctctcatggggatggg

SEQ ID NO: 4772 - DNA, 23 bp, Artificial
  gRNA target site sequence
gctctcatggggatgggcactgg

SEQ ID NO: 4773 - DNA, 23 bp, Artificial
  gRNA target site sequence
ctctcatggggatgggcactggg

SEQ ID NO: 4774 - DNA, 23 bp, Artificial
  gRNA target site sequence
ctgggtccatgctcagtgcatgg

SEQ ID NO: 4775 - DNA, 23 bp, Artificial
  gRNA target site sequence
ccatgctcagtgcatggatctgg

SEQ ID NO: 4776 - DNA, 23 bp, Artificial
  gRNA target site sequence
acactcatccatctgtcagcagg

SEQ ID NO: 4777 - DNA, 23 bp, Artificial
  gRNA target site sequence
gtattactgcaatgagcatgtgg

SEQ ID NO: 4778 - DNA, 23 bp, Artificial
  gRNA target site sequence
atgaaatccctccgtaaaaaagg

SEQ ID NO: 4779 - DNA, 23 bp, Artificial
  gRNA target site sequence
tccctccgtaaaaaaggttctgg

SEQ ID NO: 4780 - DNA, 23 bp, Artificial
  gRNA target site sequence
ccaagaaatcctttcttagaagg

SEQ ID NO: 4781 - DNA, 23 bp, Artificial
  gRNA target site sequence
tgagaagcctggctgaattaagg

SEQ ID NO: 4782 - DNA, 23 bp, Artificial
  gRNA target site sequence
aaattcatcagtgagaagcctgg

SEQ ID NO: 4783 - DNA, 23 bp, Artificial
  gRNA target site sequence
ccagtggggcaggatcttttggg

SEQ ID NO: 4784 - DNA, 23 bp, Artificial
  gRNA target site sequence
tccagtggggcaggatcttttgg

SEQ ID NO: 4785 - DNA, 23 bp, Artificial
  gRNA target site sequence
atggaaaactccagtggggcagg

SEQ ID NO: 4786 - DNA, 23 bp, Artificial
  gRNA target site sequence
ccagatggaaaactccagtgggg

SEQ ID NO: 4787 - DNA, 23 bp, Artificial
  gRNA target site sequence
tccagatggaaaactccagtggg

SEQ ID NO: 4788 - DNA, 23 bp, Artificial
  gRNA target site sequence
atccagatggaaaactccagtgg

SEQ ID NO: 4789 - DNA, 23 bp, Artificial
  gRNA target site sequence
ggttatgctttacatccagatgg

SEQ ID NO: 4790 - DNA, 23 bp, Artificial
  gRNA target site sequence
ttgtaggcttcagtttgacatgg

SEQ ID NO: 4791 - DNA, 23 bp, Artificial
  gRNA target site sequence
gaatccttagagaaaattgtagg

SEQ ID NO: 4792 - DNA, 23 bp, Artificial
  gRNA target site sequence
gcgaagaggagggaggtagcagg

SEQ ID NO: 4793 - DNA, 23 bp, Artificial
  gRNA target site sequence
ctgggtagcgaagaggagggagg

SEQ ID NO: 4794 - DNA, 23 bp, Artificial
  gRNA target site sequence
tggctgggtagcgaagaggaggg

SEQ ID NO: 4795 - DNA, 23 bp, Artificial
  gRNA target site sequence
gtggctgggtagcgaagaggagg

SEQ ID NO: 4796 - DNA, 23 bp, Artificial
  gRNA target site sequence
caagtggctgggtagcgaagagg

SEQ ID NO: 4797 - DNA, 23 bp, Artificial
  gRNA target site sequence
ctttgaatgtgcaagtggctggg

SEQ ID NO: 4798 - DNA, 23 bp, Artificial
  gRNA target site sequence
cctttgaatgtgcaagtggctgg

SEQ ID NO: 4799 - DNA, 23 bp, Artificial
  gRNA target site sequence
gctgcctttgaatgtgcaagtgg

SEQ ID NO: 4800 - DNA, 23 bp, Artificial
  gRNA target site sequence
tgtttggtgttttccctccatgg

SEQ ID NO: 4801 - DNA, 23 bp, Artificial
  gRNA target site sequence
ttatctgaaacctcattgtttgg

SEQ ID NO: 4802 - DNA, 23 bp, Artificial
  gRNA target site sequence
gaatgaccatatctggcttcagg

SEQ ID NO: 4803 - DNA, 23 bp, Artificial
  gRNA target site sequence
attaatggaatgaccatatctgg

SEQ ID NO: 4804 - DNA, 23 bp, Artificial
  gRNA target site sequence
tcggctgtacaccacattaatgg

SEQ ID NO: 4805 - DNA, 23 bp, Artificial
  gRNA target site sequence
gaacacccatacttttccctcgg

SEQ ID NO: 4806 - DNA, 23 bp, Artificial
  gRNA target site sequence
tctgtggttctgtgggtagaagg

SEQ ID NO: 4807 - DNA, 23 bp, Artificial
  gRNA target site sequence
ccatttttctgtggttctgtggg

SEQ ID NO: 4808 - DNA, 23 bp, Artificial
  gRNA target site sequence
tccatttttctgtggttctgtgg

SEQ ID NO: 4809 - DNA, 23 bp, Artificial
  gRNA target site sequence
tacactattccatttttctgtgg

SEQ ID NO: 4810 - DNA, 23 bp, Artificial
  gRNA target site sequence
ccaccaggaaaacacagggcagg

SEQ ID NO: 4811 - DNA, 23 bp, Artificial
  gRNA target site sequence
aaatccaccaggaaaacacaggg

SEQ ID NO: 4812 - DNA, 23 bp, Artificial
  gRNA target site sequence
aaaatccaccaggaaaacacagg

SEQ ID NO: 4813 - DNA, 23 bp, Artificial
  gRNA target site sequence
acccaaattcaaaatccaccagg

SEQ ID NO: 4814 - DNA, 23 bp, Artificial
  gRNA target site sequence
gatagcccatcctgaagttctgg

SEQ ID NO: 4815 - DNA, 23 bp, Artificial
  gRNA target site sequence
aatatagatggtgtcatttttgg

SEQ ID NO: 4816 - DNA, 23 bp, Artificial
  gRNA target site sequence
atgtcctcctaaaatatagatgg

SEQ ID NO: 4817 - DNA, 23 bp, Artificial
  gRNA target site sequence
gttggcaggccggatattattgg

SEQ ID NO: 4818 - DNA, 23 bp, Artificial
  gRNA target site sequence
ttctgtacaggttggcaggccgg

SEQ ID NO: 4819 - DNA, 23 bp, Artificial
  gRNA target site sequence
cttattctgtacaggttggcagg

SEQ ID NO: 4820 - DNA, 23 bp, Artificial
  gRNA target site sequence
aacccttattctgtacaggttgg

SEQ ID NO: 4821 - DNA, 23 bp, Artificial
  gRNA target site sequence
gatcaacccttattctgtacagg

SEQ ID NO: 4822 - DNA, 23 bp, Artificial
  gRNA target site sequence
ttcacagctgggctacccagggg

SEQ ID NO: 4823 - DNA, 23 bp, Artificial
  gRNA target site sequence
attcacagctgggctacccaggg

SEQ ID NO: 4824 - DNA, 23 bp, Artificial
  gRNA target site sequence
aattcacagctgggctacccagg

SEQ ID NO: 4825 - DNA, 23 bp, Artificial
  gRNA target site sequence
agactgtgcaattcacagctggg

SEQ ID NO: 4826 - DNA, 23 bp, Artificial
  gRNA target site sequence
aagactgtgcaattcacagctgg

SEQ ID NO: 4827 - DNA, 23 bp, Artificial
  gRNA target site sequence
ctggagacagagattcctcctgg

SEQ ID NO: 4828 - DNA, 23 bp, Artificial
  gRNA target site sequence
agtttgagtcaggattgcactgg

SEQ ID NO: 4829 - DNA, 23 bp, Artificial
  gRNA target site sequence
catcattgttagtttgagtcagg

SEQ ID NO: 4830 - DNA, 23 bp, Artificial
  gRNA target site sequence
aatgtctggggtccaatctgggg

SEQ ID NO: 4831 - DNA, 23 bp, Artificial
  gRNA target site sequence
taatgtctggggtccaatctggg

SEQ ID NO: 4832 - DNA, 23 bp, Artificial
  gRNA target site sequence
ttaatgtctggggtccaatctgg

SEQ ID NO: 4833 - DNA, 23 bp, Artificial
  gRNA target site sequence
cttgctgtgcttaatgtctgggg

SEQ ID NO: 4834 - DNA, 23 bp, Artificial
  gRNA target site sequence
tcttgctgtgcttaatgtctggg

SEQ ID NO: 4835 - DNA, 23 bp, Artificial
  gRNA target site sequence
atcttgctgtgcttaatgtctgg

SEQ ID NO: 4836 - DNA, 23 bp, Artificial
  gRNA target site sequence
acaacttgtttattgtctcctgg

SEQ ID NO: 4837 - DNA, 23 bp, Artificial
  gRNA target site sequence
tcaaagggagtggaatcccctgg

SEQ ID NO: 4838 - DNA, 23 bp, Artificial
  gRNA target site sequence
ttcagagtcttcaaagggagtgg

SEQ ID NO: 4839 - DNA, 23 bp, Artificial
  gRNA target site sequence
aattcttcagagtcttcaaaggg

SEQ ID NO: 4840 - DNA, 23 bp, Artificial
  gRNA target site sequence
aaattcttcagagtcttcaaagg

SEQ ID NO: 4841 - DNA, 23 bp, Artificial
  gRNA target site sequence
ttcttcatcatcttcattatagg

SEQ ID NO: 4842 - DNA, 23 bp, Artificial
  gRNA target site sequence
tgatatccacatcacaagtaggg

SEQ ID NO: 4843 - DNA, 23 bp, Artificial
  gRNA target site sequence
ttgatatccacatcacaagtagg

SEQ ID NO: 4844 - DNA, 23 bp, Artificial
  gRNA target site sequence
ttgagctcagttgaatagaatgg

SEQ ID NO: 4845 - DNA, 23 bp, Artificial
  gRNA target site sequence
tgagagcagtagatcatggcggg

SEQ ID NO: 4846 - DNA, 23 bp, Artificial
  gRNA target site sequence
atgagagcagtagatcatggcgg

SEQ ID NO: 4847 - DNA, 23 bp, Artificial
  gRNA target site sequence
cccatgagagcagtagatcatgg

SEQ ID NO: 4848 - DNA, 23 bp, Artificial
  gRNA target site sequence
ccagatccatgcactgagcatgg

SEQ ID NO: 4849 - DNA, 23 bp, Artificial
  gRNA target site sequence
tgttgcttcctgctgacagatgg

SEQ ID NO: 4850 - DNA, 23 bp, Artificial
  gRNA target site sequence
tttaagggtaggactctttgggg

SEQ ID NO: 4851 - DNA, 23 bp, Artificial
  gRNA target site sequence
ttttaagggtaggactctttggg

SEQ ID NO: 4852 - DNA, 23 bp, Artificial
  gRNA target site sequence
tttttaagggtaggactctttgg

SEQ ID NO: 4853 - DNA, 23 bp, Artificial
  gRNA target site sequence
ttggaggcttttttaagggtagg

SEQ ID NO: 4854 - DNA, 23 bp, Artificial
  gRNA target site sequence
ttcattggaggcttttttaaggg

SEQ ID NO: 4855 - DNA, 23 bp, Artificial
  gRNA target site sequence
tttcattggaggcttttttaagg

SEQ ID NO: 4856 - DNA, 23 bp, Artificial
  gRNA target site sequence
ttacggagggatttcattggagg

SEQ ID NO: 4857 - DNA, 23 bp, Artificial
  gRNA target site sequence
tttttacggagggatttcattgg

SEQ ID NO: 4858 - DNA, 23 bp, Artificial
  gRNA target site sequence
tccagaaccttttttacggaggg

SEQ ID NO: 4859 - DNA, 23 bp, Artificial
  gRNA target site sequence
ttccagaaccttttttacggagg

SEQ ID NO: 4860 - DNA, 23 bp, Artificial
  gRNA target site sequence
tttttccagaaccttttttacgg

SEQ ID NO: 4861 - DNA, 23 bp, Artificial
  gRNA target site sequence
ctaagaaaggatttcttggcagg

SEQ ID NO: 4862 - DNA, 23 bp, Artificial
  gRNA target site sequence
ccttctaagaaaggatttcttgg

SEQ ID NO: 4863 - DNA, 23 bp, Artificial
  gRNA target site sequence
atcaaacaaccttctaagaaagg

SEQ ID NO: 4864 - DNA, 23 bp, Artificial
  gRNA target site sequence
gcaggtttcgggaggcccagggg

SEQ ID NO: 4865 - DNA, 23 bp, Artificial
  gRNA target site sequence
aggggcgatgccagaccccgcgg

SEQ ID NO: 4866 - DNA, 23 bp, Artificial
  gRNA target site sequence
gcgcacctgcccttcttctacgg

SEQ ID NO: 4867 - DNA, 23 bp, Artificial
  gRNA target site sequence
cggcagcatctcgcgtgccgagg

SEQ ID NO: 4868 - DNA, 23 bp, Artificial
  gRNA target site sequence
catctcgcgtgccgaggccgagg

SEQ ID NO: 4869 - DNA, 23 bp, Artificial
  gRNA target site sequence
ggccgaggagcacctgaagctgg

SEQ ID NO: 4870 - DNA, 23 bp, Artificial
  gRNA target site sequence
cgaggagcacctgaagctggcgg

SEQ ID NO: 4871 - DNA, 23 bp, Artificial
  gRNA target site sequence
gaggagcacctgaagctggcggg

SEQ ID NO: 4872 - DNA, 23 bp, Artificial
  gRNA target site sequence
gcacctgaagctggcgggcatgg

SEQ ID NO: 4873 - DNA, 23 bp, Artificial
  gRNA target site sequence
cctgaagctggcgggcatggcgg

SEQ ID NO: 4874 - DNA, 23 bp, Artificial
  gRNA target site sequence
aagctggcgggcatggcggacgg

SEQ ID NO: 4875 - DNA, 23 bp, Artificial
  gRNA target site sequence
agctggcgggcatggcggacggg

SEQ ID NO: 4876 - DNA, 23 bp, Artificial
  gRNA target site sequence
gcgccagtgcctgcgctcgctgg

SEQ ID NO: 4877 - DNA, 23 bp, Artificial
  gRNA target site sequence
cgccagtgcctgcgctcgctggg

SEQ ID NO: 4878 - DNA, 23 bp, Artificial
  gRNA target site sequence
cagtgcctgcgctcgctgggcgg

SEQ ID NO: 4879 - DNA, 23 bp, Artificial
  gRNA target site sequence
cccatcgagcgccagctcaacgg

SEQ ID NO: 4880 - DNA, 23 bp, Artificial
  gRNA target site sequence
aacggcacctacgccattgccgg

SEQ ID NO: 4881 - DNA, 23 bp, Artificial
  gRNA target site sequence
ggcacctacgccattgccggcgg

SEQ ID NO: 4882 - DNA, 23 bp, Artificial
  gRNA target site sequence
gccggcggcaaagcgcactgtgg

SEQ ID NO: 4883 - DNA, 23 bp, Artificial
  gRNA target site sequence
cggcaaagcgcactgtggaccgg

SEQ ID NO: 4884 - DNA, 23 bp, Artificial
  gRNA target site sequence
ttctactcgcgcgaccccgacgg

SEQ ID NO: 4885 - DNA, 23 bp, Artificial
  gRNA target site sequence
tctactcgcgcgaccccgacggg

SEQ ID NO: 4886 - DNA, 23 bp, Artificial
  gRNA target site sequence
acctgcgcaagccgtgcaaccgg

SEQ ID NO: 4887 - DNA, 23 bp, Artificial
  gRNA target site sequence
caagccgtgcaaccggccgtcgg

SEQ ID NO: 4888 - DNA, 23 bp, Artificial
  gRNA target site sequence
aagccgtgcaaccggccgtcggg

SEQ ID NO: 4889 - DNA, 23 bp, Artificial
  gRNA target site sequence
gtcgggcctcgagccgcagccgg

SEQ ID NO: 4890 - DNA, 23 bp, Artificial
  gRNA target site sequence
tcgggcctcgagccgcagccggg

SEQ ID NO: 4891 - DNA, 23 bp, Artificial
  gRNA target site sequence
cgggcctcgagccgcagccgggg

SEQ ID NO: 4892 - DNA, 23 bp, Artificial
  gRNA target site sequence
gggcctcgagccgcagccggggg

SEQ ID NO: 4893 - DNA, 23 bp, Artificial
  gRNA target site sequence
cgactgcctgcgagacgccatgg

SEQ ID NO: 4894 - DNA, 23 bp, Artificial
  gRNA target site sequence
gtgactacgtgcgccagacgtgg

SEQ ID NO: 4895 - DNA, 23 bp, Artificial
  gRNA target site sequence
cgtgcgccagacgtggaagctgg

SEQ ID NO: 4896 - DNA, 23 bp, Artificial
  gRNA target site sequence
gcgccagacgtggaagctggagg

SEQ ID NO: 4897 - DNA, 23 bp, Artificial
  gRNA target site sequence
ctggaggtgagagcgcagcctgg

SEQ ID NO: 4898 - DNA, 23 bp, Artificial
  gRNA target site sequence
tggaggtgagagcgcagcctggg

SEQ ID NO: 4899 - DNA, 23 bp, Artificial
  gRNA target site sequence
ggaggtgagagcgcagcctgggg

SEQ ID NO: 4900 - DNA, 23 bp, Artificial
  gRNA target site sequence
tgagagcgcagcctggggcgcgg

SEQ ID NO: 4901 - DNA, 23 bp, Artificial
  gRNA target site sequence
gagagcgcagcctggggcgcggg

SEQ ID NO: 4902 - DNA, 23 bp, Artificial
  gRNA target site sequence
cggggtctggcatcgcccctggg

SEQ ID NO: 4903 - DNA, 23 bp, Artificial
  gRNA target site sequence
gcggggtctggcatcgcccctgg

SEQ ID NO: 4904 - DNA, 23 bp, Artificial
  gRNA target site sequence
ggcaggtgcgccgcggggtctgg

SEQ ID NO: 4905 - DNA, 23 bp, Artificial
  gRNA target site sequence
agaagggcaggtgcgccgcgggg

SEQ ID NO: 4906 - DNA, 23 bp, Artificial
  gRNA target site sequence
aagaagggcaggtgcgccgcggg

SEQ ID NO: 4907 - DNA, 23 bp, Artificial
  gRNA target site sequence
gaagaagggcaggtgcgccgcgg

SEQ ID NO: 4908 - DNA, 23 bp, Artificial
  gRNA target site sequence
tgctgccgtagaagaagggcagg

SEQ ID NO: 4909 - DNA, 23 bp, Artificial
  gRNA target site sequence
gagatgctgccgtagaagaaggg

SEQ ID NO: 4910 - DNA, 23 bp, Artificial
  gRNA target site sequence
cgagatgctgccgtagaagaagg

SEQ ID NO: 4911 - DNA, 23 bp, Artificial
  gRNA target site sequence
cttcaggtgctcctcggcctcgg

SEQ ID NO: 4912 - DNA, 23 bp, Artificial
  gRNA target site sequence
cgccagcttcaggtgctcctcgg

SEQ ID NO: 4913 - DNA, 23 bp, Artificial
  gRNA target site sequence
ccgccatgcccgccagcttcagg

SEQ ID NO: 4914 - DNA, 23 bp, Artificial
  gRNA target site sequence
agcgcaggcactggcgcagcagg

SEQ ID NO: 4915 - DNA, 23 bp, Artificial
  gRNA target site sequence
cgcccagcgagcgcaggcactgg

SEQ ID NO: 4916 - DNA, 23 bp, Artificial
  gRNA target site sequence
catagccgcccagcgagcgcagg

SEQ ID NO: 4917 - DNA, 23 bp, Artificial
  gRNA target site sequence
ggcgctcgatgggaaagtggtgg

SEQ ID NO: 4918 - DNA, 23 bp, Artificial
  gRNA target site sequence
gctggcgctcgatgggaaagtgg

SEQ ID NO: 4919 - DNA, 23 bp, Artificial
  gRNA target site sequence
ccgttgagctggcgctcgatggg

SEQ ID NO: 4920 - DNA, 23 bp, Artificial
  gRNA target site sequence
gccgttgagctggcgctcgatgg

SEQ ID NO: 4921 - DNA, 23 bp, Artificial
  gRNA target site sequence
tggcgtaggtgccgttgagctgg

SEQ ID NO: 4922 - DNA, 23 bp, Artificial
  gRNA target site sequence
tttgccgccggcaatggcgtagg

SEQ ID NO: 4923 - DNA, 23 bp, Artificial
  gRNA target site sequence
gtgcgctttgccgccggcaatgg

SEQ ID NO: 4924 - DNA, 23 bp, Artificial
  gRNA target site sequence
tccacagtgcgctttgccgccgg

SEQ ID NO: 4925 - DNA, 23 bp, Artificial
  gRNA target site sequence
tagaactcgcagagctctgccgg

SEQ ID NO: 4926 - DNA, 23 bp, Artificial
  gRNA target site sequence
ggttgcagggcagcccgtcgggg

SEQ ID NO: 4927 - DNA, 23 bp, Artificial
  gRNA target site sequence
aggttgcagggcagcccgtcggg

SEQ ID NO: 4928 - DNA, 23 bp, Artificial
  gRNA target site sequence
caggttgcagggcagcccgtcgg

SEQ ID NO: 4929 - DNA, 23 bp, Artificial
  gRNA target site sequence
cacggcttgcgcaggttgcaggg

SEQ ID NO: 4930 - DNA, 23 bp, Artificial
  gRNA target site sequence
gcacggcttgcgcaggttgcagg

SEQ ID NO: 4931 - DNA, 23 bp, Artificial
  gRNA target site sequence
gccggttgcacggcttgcgcagg

SEQ ID NO: 4932 - DNA, 23 bp, Artificial
  gRNA target site sequence
aggcccgacggccggttgcacgg

SEQ ID NO: 4933 - DNA, 23 bp, Artificial
  gRNA target site sequence
gcggctcgaggcccgacggccgg

SEQ ID NO: 4934 - DNA, 23 bp, Artificial
  gRNA target site sequence
ggctgcggctcgaggcccgacgg

SEQ ID NO: 4935 - DNA, 23 bp, Artificial
  gRNA target site sequence
agacccccggctgcggctcgagg

SEQ ID NO: 4936 - DNA, 23 bp, Artificial
  gRNA target site sequence
cagtcgaagacccccggctgcgg

SEQ ID NO: 4937 - DNA, 23 bp, Artificial
  gRNA target site sequence
cgcaggcagtcgaagacccccgg

SEQ ID NO: 4938 - DNA, 23 bp, Artificial
  gRNA target site sequence
cacgcaccatggcgtctcgcagg

SEQ ID NO: 4939 - DNA, 23 bp, Artificial
  gRNA target site sequence
gcgcacgtagtcacgcaccatgg

SEQ ID NO: 4940 - DNA, 23 bp, Artificial
  gRNA target site sequence
tcacctccagcttccacgtctgg

SEQ ID NO: 4941 - DNA, 23 bp, Artificial
  gRNA target site sequence
ctcctcgcctctccttttctagg

SEQ ID NO: 4942 - DNA, 23 bp, Artificial
  gRNA target site sequence
tcctcgcctctccttttctaggg

SEQ ID NO: 4943 - DNA, 23 bp, Artificial
  gRNA target site sequence
gcctctccttttctagggcgagg

SEQ ID NO: 4944 - DNA, 23 bp, Artificial
  gRNA target site sequence
ccttttctagggcgaggccctgg

SEQ ID NO: 4945 - DNA, 23 bp, Artificial
  gRNA target site sequence
ctagggcgaggccctggagcagg

SEQ ID NO: 4946 - DNA, 23 bp, Artificial
  gRNA target site sequence
ggagcaggccatcatcagccagg

SEQ ID NO: 4947 - DNA, 23 bp, Artificial
  gRNA target site sequence
catcatcagccaggccccgcagg

SEQ ID NO: 4948 - DNA, 23 bp, Artificial
  gRNA target site sequence
catcagccaggccccgcaggtgg

SEQ ID NO: 4949 - DNA, 23 bp, Artificial
  gRNA target site sequence
ggagaagctcattgctacgacgg

SEQ ID NO: 4950 - DNA, 23 bp, Artificial
  gRNA target site sequence
ttgctacgacggcccacgagcgg

SEQ ID NO: 4951 - DNA, 23 bp, Artificial
  gRNA target site sequence
cggcccacgagcggatgccctgg

SEQ ID NO: 4952 - DNA, 23 bp, Artificial
  gRNA target site sequence
ccacagcagcctgacgcgtgagg

SEQ ID NO: 4953 - DNA, 23 bp, Artificial
  gRNA target site sequence
cagcagcctgacgcgtgaggagg

SEQ ID NO: 4954 - DNA, 23 bp, Artificial
  gRNA target site sequence
gccgagcgcaaactttactctgg

SEQ ID NO: 4955 - DNA, 23 bp, Artificial
  gRNA target site sequence
ccgagcgcaaactttactctggg

SEQ ID NO: 4956 - DNA, 23 bp, Artificial
  gRNA target site sequence
cgagcgcaaactttactctgggg

SEQ ID NO: 4957 - DNA, 23 bp, Artificial
  gRNA target site sequence
tactctggggcgcagaccgacgg

SEQ ID NO: 4958 - DNA, 23 bp, Artificial
  gRNA target site sequence
cgacggcaagttcctgtatgtgg

SEQ ID NO: 4959 - DNA, 23 bp, Artificial
  gRNA target site sequence
gacggcaagttcctgtatgtggg

SEQ ID NO: 4960 - DNA, 23 bp, Artificial
  gRNA target site sequence
acggcaagttcctgtatgtgggg

SEQ ID NO: 4961 - DNA, 23 bp, Artificial
  gRNA target site sequence
aagttcctgtatgtggggcccgg

SEQ ID NO: 4962 - DNA, 23 bp, Artificial
  gRNA target site sequence
agttcctgtatgtggggcccggg

SEQ ID NO: 4963 - DNA, 23 bp, Artificial
  gRNA target site sequence
tgtatgtggggcccgggatttgg

SEQ ID NO: 4964 - DNA, 23 bp, Artificial
  gRNA target site sequence
gtatgtggggcccgggatttggg

SEQ ID NO: 4965 - DNA, 23 bp, Artificial
  gRNA target site sequence
ctagaaaaggagaggcgaggagg

SEQ ID NO: 4966 - DNA, 23 bp, Artificial
  gRNA target site sequence
gccctagaaaaggagaggcgagg

SEQ ID NO: 4967 - DNA, 23 bp, Artificial
  gRNA target site sequence
gcctcgccctagaaaaggagagg

SEQ ID NO: 4968 - DNA, 23 bp, Artificial
  gRNA target site sequence
ccagggcctcgccctagaaaagg

SEQ ID NO: 4969 - DNA, 23 bp, Artificial
  gRNA target site sequence
gctgatgatggcctgctccaggg

SEQ ID NO: 4970 - DNA, 23 bp, Artificial
  gRNA target site sequence
ggctgatgatggcctgctccagg

SEQ ID NO: 4971 - DNA, 23 bp, Artificial
  gRNA target site sequence
ctgcggggcctggctgatgatgg

SEQ ID NO: 4972 - DNA, 23 bp, Artificial
  gRNA target site sequence
gcttctccacctgcggggcctgg

SEQ ID NO: 4973 - DNA, 23 bp, Artificial
  gRNA target site sequence
aatgagcttctccacctgcgggg

SEQ ID NO: 4974 - DNA, 23 bp, Artificial
  gRNA target site sequence
caatgagcttctccacctgcggg

SEQ ID NO: 4975 - DNA, 23 bp, Artificial
  gRNA target site sequence
gcaatgagcttctccacctgcgg

SEQ ID NO: 4976 - DNA, 23 bp, Artificial
  gRNA target site sequence
gtaccagggcatccgctcgtggg

SEQ ID NO: 4977 - DNA, 23 bp, Artificial
  gRNA target site sequence
ggtaccagggcatccgctcgtgg

SEQ ID NO: 4978 - DNA, 23 bp, Artificial
  gRNA target site sequence
gtcaggctgctgtggtaccaggg

SEQ ID NO: 4979 - DNA, 23 bp, Artificial
  gRNA target site sequence
cgtcaggctgctgtggtaccagg

SEQ ID NO: 4980 - DNA, 23 bp, Artificial
  gRNA target site sequence
cctcacgcgtcaggctgctgtgg

SEQ ID NO: 4981 - DNA, 23 bp, Artificial
  gRNA target site sequence
gctcggcctcctcacgcgtcagg

SEQ ID NO: 4982 - DNA, 23 bp, Artificial
  gRNA target site sequence
cccagagtaaagtttgcgctcgg

SEQ ID NO: 4983 - DNA, 23 bp, Artificial
  gRNA target site sequence
cacatacaggaacttgccgtcgg

SEQ ID NO: 4984 - DNA, 23 bp, Artificial
  gRNA target site sequence
aaatcccgggccccacatacagg

SEQ ID NO: 4985 - DNA, 23 bp, Artificial
  gRNA target site sequence
atcccctcccttcccctgccagg

SEQ ID NO: 4986 - DNA, 23 bp, Artificial
  gRNA target site sequence
tcccttcccctgccaggctgagg

SEQ ID NO: 4987 - DNA, 23 bp, Artificial
  gRNA target site sequence
cccctgccaggctgaggccgcgg

SEQ ID NO: 4988 - DNA, 23 bp, Artificial
  gRNA target site sequence
tgccaggctgaggccgcggaagg

SEQ ID NO: 4989 - DNA, 23 bp, Artificial
  gRNA target site sequence
gctgaggccgcggaaggagcagg

SEQ ID NO: 4990 - DNA, 23 bp, Artificial
  gRNA target site sequence
ctgaggccgcggaaggagcaggg

SEQ ID NO: 4991 - DNA, 23 bp, Artificial
  gRNA target site sequence
tacgccctgtccctcatctatgg

SEQ ID NO: 4992 - DNA, 23 bp, Artificial
  gRNA target site sequence
acgccctgtccctcatctatggg

SEQ ID NO: 4993 - DNA, 23 bp, Artificial
  gRNA target site sequence
gtccctcatctatgggaagacgg

SEQ ID NO: 4994 - DNA, 23 bp, Artificial
  gRNA target site sequence
ctacctcatcagccaagacaagg

SEQ ID NO: 4995 - DNA, 23 bp, Artificial
  gRNA target site sequence
cctcatcagccaagacaaggcgg

SEQ ID NO: 4996 - DNA, 23 bp, Artificial
  gRNA target site sequence
ctcatcagccaagacaaggcggg

SEQ ID NO: 4997 - DNA, 23 bp, Artificial
  gRNA target site sequence
gggcaagtactgcattcccgagg

SEQ ID NO: 4998 - DNA, 23 bp, Artificial
  gRNA target site sequence
ggcaagtactgcattcccgaggg

SEQ ID NO: 4999 - DNA, 23 bp, Artificial
  gRNA target site sequence
gcaccaagtttgacacgctctgg

SEQ ID NO: 5000 - DNA, 23 bp, Artificial
  gRNA target site sequence
caagtttgacacgctctggcagg

SEQ ID NO: 5001 - DNA, 23 bp, Artificial
  gRNA target site sequence
tttgacacgctctggcaggtagg

SEQ ID NO: 5002 - DNA, 23 bp, Artificial
  gRNA target site sequence
agcctggcaggggaagggagggg

SEQ ID NO: 5003 - DNA, 23 bp, Artificial
  gRNA target site sequence
cagcctggcaggggaagggaggg

SEQ ID NO: 5004 - DNA, 23 bp, Artificial
  gRNA target site sequence
tcagcctggcaggggaagggagg

SEQ ID NO: 5005 - DNA, 23 bp, Artificial
  gRNA target site sequence
gcctcagcctggcaggggaaggg

SEQ ID NO: 5006 - DNA, 23 bp, Artificial
  gRNA target site sequence
ggcctcagcctggcaggggaagg

SEQ ID NO: 5007 - DNA, 23 bp, Artificial
  gRNA target site sequence
ccgcggcctcagcctggcagggg

SEQ ID NO: 5008 - DNA, 23 bp, Artificial
  gRNA target site sequence
tccgcggcctcagcctggcaggg

SEQ ID NO: 5009 - DNA, 23 bp, Artificial
  gRNA target site sequence
ttccgcggcctcagcctggcagg

SEQ ID NO: 5010 - DNA, 23 bp, Artificial
  gRNA target site sequence
ctccttccgcggcctcagcctgg

SEQ ID NO: 5011 - DNA, 23 bp, Artificial
  gRNA target site sequence
tatgtgccctgctccttccgcgg

SEQ ID NO: 5012 - DNA, 23 bp, Artificial
  gRNA target site sequence
cttcccatagatgagggacaggg

SEQ ID NO: 5013 - DNA, 23 bp, Artificial
  gRNA target site sequence
tcttcccatagatgagggacagg

SEQ ID NO: 5014 - DNA, 23 bp, Artificial
  gRNA target site sequence
caccgtcttcccatagatgaggg

SEQ ID NO: 5015 - DNA, 23 bp, Artificial
  gRNA target site sequence
acaccgtcttcccatagatgagg

SEQ ID NO: 5016 - DNA, 23 bp, Artificial
  gRNA target site sequence
tgtcttggctgatgaggtagtgg

SEQ ID NO: 5017 - DNA, 23 bp, Artificial
  gRNA target site sequence
ccgccttgtcttggctgatgagg

SEQ ID NO: 5018 - DNA, 23 bp, Artificial
  gRNA target site sequence
agtacttgcccgccttgtcttgg

SEQ ID NO: 5019 - DNA, 23 bp, Artificial
  gRNA target site sequence
gtgtcaaacttggtgccctcggg

SEQ ID NO: 5020 - DNA, 23 bp, Artificial
  gRNA target site sequence
cgtgtcaaacttggtgccctcgg

SEQ ID NO: 5021 - DNA, 23 bp, Artificial
  gRNA target site sequence
ctgccagagcgtgtcaaacttgg

SEQ ID NO: 5022 - DNA, 23 bp, Artificial
  gRNA target site sequence
agctgcctgctccctgcagctgg

SEQ ID NO: 5023 - DNA, 23 bp, Artificial
  gRNA target site sequence
tgcctgctccctgcagctggtgg

SEQ ID NO: 5024 - DNA, 23 bp, Artificial
  gRNA target site sequence
ggtggagtatctgaagctgaagg

SEQ ID NO: 5025 - DNA, 23 bp, Artificial
  gRNA target site sequence
ggagtatctgaagctgaaggcgg

SEQ ID NO: 5026 - DNA, 23 bp, Artificial
  gRNA target site sequence
tatctgaagctgaaggcggacgg

SEQ ID NO: 5027 - DNA, 23 bp, Artificial
  gRNA target site sequence
atctgaagctgaaggcggacggg

SEQ ID NO: 5028 - DNA, 23 bp, Artificial
  gRNA target site sequence
cgggctcatctactgcctgaagg

SEQ ID NO: 5029 - DNA, 23 bp, Artificial
  gRNA target site sequence
gctcatctactgcctgaaggagg

SEQ ID NO: 5030 - DNA, 23 bp, Artificial
  gRNA target site sequence
agcagtgccagcaacgcctcagg

SEQ ID NO: 5031 - DNA, 23 bp, Artificial
  gRNA target site sequence
gccagcaacgcctcaggtgacgg

SEQ ID NO: 5032 - DNA, 23 bp, Artificial
  gRNA target site sequence
acgcctcaggtgacggcagcagg

SEQ ID NO: 5033 - DNA, 23 bp, Artificial
  gRNA target site sequence
cctcaggtgacggcagcaggcgg

SEQ ID NO: 5034 - DNA, 23 bp, Artificial
  gRNA target site sequence
ctcaggtgacggcagcaggcggg

SEQ ID NO: 5035 - DNA, 23 bp, Artificial
  gRNA target site sequence
aggtgacggcagcaggcgggcgg

SEQ ID NO: 5036 - DNA, 23 bp, Artificial
  gRNA target site sequence
ggtgacggcagcaggcgggcggg

SEQ ID NO: 5037 - DNA, 23 bp, Artificial
  gRNA target site sequence
gacggcagcaggcgggcgggcgg

SEQ ID NO: 5038 - DNA, 23 bp, Artificial
  gRNA target site sequence
ctccaccagctgcagggagcagg

SEQ ID NO: 5039 - DNA, 23 bp, Artificial
  gRNA target site sequence
cagatactccaccagctgcaggg

SEQ ID NO: 5040 - DNA, 23 bp, Artificial
  gRNA target site sequence
tcagatactccaccagctgcagg

SEQ ID NO: 5041 - DNA, 23 bp, Artificial
  gRNA target site sequence
tgttggggcaggcctccttcagg

SEQ ID NO: 5042 - DNA, 23 bp, Artificial
  gRNA target site sequence
gctggcactgctgttggggcagg

SEQ ID NO: 5043 - DNA, 23 bp, Artificial
  gRNA target site sequence
cgttgctggcactgctgttgggg

SEQ ID NO: 5044 - DNA, 23 bp, Artificial
  gRNA target site sequence
gcgttgctggcactgctgttggg

SEQ ID NO: 5045 - DNA, 23 bp, Artificial
  gRNA target site sequence
ggcgttgctggcactgctgttgg

SEQ ID NO: 5046 - DNA, 23 bp, Artificial
  gRNA target site sequence
gccgtcacctgaggcgttgctgg

SEQ ID NO: 5047 - DNA, 23 bp, Artificial
  gRNA target site sequence
ccgcctgctgccgtcacctgagg

SEQ ID NO: 5048 - DNA, 23 bp, Artificial
  gRNA target site sequence
actgtcccttctgctcccccagg

SEQ ID NO: 5049 - DNA, 23 bp, Artificial
  gRNA target site sequence
ctgtcccttctgctcccccaggg

SEQ ID NO: 5050 - DNA, 23 bp, Artificial
  gRNA target site sequence
tgtcccttctgctcccccagggg

SEQ ID NO: 5051 - DNA, 23 bp, Artificial
  gRNA target site sequence
ccacgttgactcatgtgagttgg

SEQ ID NO: 5052 - DNA, 23 bp, Artificial
  gRNA target site sequence
cacgttgactcatgtgagttggg

SEQ ID NO: 5053 - DNA, 23 bp, Artificial
  gRNA target site sequence
acgttgactcatgtgagttgggg

SEQ ID NO: 5054 - DNA, 23 bp, Artificial
  gRNA target site sequence
cgttgactcatgtgagttggggg

SEQ ID NO: 5055 - DNA, 23 bp, Artificial
  gRNA target site sequence
tcatgtgagttgggggcacctgg

SEQ ID NO: 5056 - DNA, 23 bp, Artificial
  gRNA target site sequence
cagcccctgggggagcagaaggg

SEQ ID NO: 5057 - DNA, 23 bp, Artificial
  gRNA target site sequence
gcagcccctgggggagcagaagg

SEQ ID NO: 5058 - DNA, 23 bp, Artificial
  gRNA target site sequence
gtgggagcagcagcccctggggg

SEQ ID NO: 5059 - DNA, 23 bp, Artificial
  gRNA target site sequence
tgtgggagcagcagcccctgggg

SEQ ID NO: 5060 - DNA, 23 bp, Artificial
  gRNA target site sequence
gtgtgggagcagcagcccctggg

SEQ ID NO: 5061 - DNA, 23 bp, Artificial
  gRNA target site sequence
agtgtgggagcagcagcccctgg

SEQ ID NO: 5062 - DNA, 23 bp, Artificial
  gRNA target site sequence
gatgggtgggctgggagtgtggg

SEQ ID NO: 5063 - DNA, 23 bp, Artificial
  gRNA target site sequence
ggatgggtgggctgggagtgtgg

SEQ ID NO: 5064 - DNA, 23 bp, Artificial
  gRNA target site sequence
tcaacgtggatgggtgggctggg

SEQ ID NO: 5065 - DNA, 23 bp, Artificial
  gRNA target site sequence
gtcaacgtggatgggtgggctgg

SEQ ID NO: 5066 - DNA, 23 bp, Artificial
  gRNA target site sequence
atgagtcaacgtggatgggtggg

SEQ ID NO: 5067 - DNA, 23 bp, Artificial
  gRNA target site sequence
catgagtcaacgtggatgggtgg

SEQ ID NO: 5068 - DNA, 23 bp, Artificial
  gRNA target site sequence
tcacatgagtcaacgtggatggg

SEQ ID NO: 5069 - DNA, 23 bp, Artificial
  gRNA target site sequence
ctcacatgagtcaacgtggatgg

SEQ ID NO: 5070 - DNA, 23 bp, Artificial
  gRNA target site sequence
ccaactcacatgagtcaacgtgg

SEQ ID NO: 5071 - DNA, 23 bp, Artificial
  gRNA target site sequence
atcgacaccctcaactcagatgg

SEQ ID NO: 5072 - DNA, 23 bp, Artificial
  gRNA target site sequence
gatggatacacccctgagccagg

SEQ ID NO: 5073 - DNA, 23 bp, Artificial
  gRNA target site sequence
acacccctgagccaggtgagcgg

SEQ ID NO: 5074 - DNA, 23 bp, Artificial
  gRNA target site sequence
cacccctgagccaggtgagcggg

SEQ ID NO: 5075 - DNA, 23 bp, Artificial
  gRNA target site sequence
tgagccaggtgagcgggcagagg

SEQ ID NO: 5076 - DNA, 23 bp, Artificial
  gRNA target site sequence
gccaggtgagcgggcagaggtgg

SEQ ID NO: 5077 - DNA, 23 bp, Artificial
  gRNA target site sequence
ccaggtgagcgggcagaggtggg

SEQ ID NO: 5078 - DNA, 23 bp, Artificial
  gRNA target site sequence
caggtgagcgggcagaggtgggg

SEQ ID NO: 5079 - DNA, 23 bp, Artificial
  gRNA target site sequence
taaaggccacagggtcagcaagg

SEQ ID NO: 5080 - DNA, 23 bp, Artificial
  gRNA target site sequence
ctctgaggctaaaggccacaggg

SEQ ID NO: 5081 - DNA, 23 bp, Artificial
  gRNA target site sequence
tctctgaggctaaaggccacagg

SEQ ID NO: 5082 - DNA, 23 bp, Artificial
  gRNA target site sequence
cgattcgtctctgaggctaaagg

SEQ ID NO: 5083 - DNA, 23 bp, Artificial
  gRNA target site sequence
agggtgtcgattcgtctctgagg

SEQ ID NO: 5084 - DNA, 23 bp, Artificial
  gRNA target site sequence
ggtgtatccatctgagttgaggg

SEQ ID NO: 5085 - DNA, 23 bp, Artificial
  gRNA target site sequence
gggtgtatccatctgagttgagg

SEQ ID NO: 5086 - DNA, 23 bp, Artificial
  gRNA target site sequence
tgcccgctcacctggctcagggg

SEQ ID NO: 5087 - DNA, 23 bp, Artificial
  gRNA target site sequence
ctgcccgctcacctggctcaggg

SEQ ID NO: 5088 - DNA, 23 bp, Artificial
  gRNA target site sequence
tctgcccgctcacctggctcagg

SEQ ID NO: 5089 - DNA, 23 bp, Artificial
  gRNA target site sequence
cccacctctgcccgctcacctgg

SEQ ID NO: 5090 - DNA, 23 bp, Artificial
  gRNA target site sequence
taacgtccccagacaaaccgcgg

SEQ ID NO: 5091 - DNA, 23 bp, Artificial
  gRNA target site sequence
caaaccgcggccgatgcccatgg

SEQ ID NO: 5092 - DNA, 23 bp, Artificial
  gRNA target site sequence
gagcccctacagcgacccagagg

SEQ ID NO: 5093 - DNA, 23 bp, Artificial
  gRNA target site sequence
cagcgacccagaggagctcaagg

SEQ ID NO: 5094 - DNA, 23 bp, Artificial
  gRNA target site sequence
ctcatagctgacattgaacttgg

SEQ ID NO: 5095 - DNA, 23 bp, Artificial
  gRNA target site sequence
gctgacattgaacttggctgcgg

SEQ ID NO: 5096 - DNA, 23 bp, Artificial
  gRNA target site sequence
gaacttggctgcggcaactttgg

SEQ ID NO: 5097 - DNA, 23 bp, Artificial
  gRNA target site sequence
caactttggctcagtgcgccagg

SEQ ID NO: 5098 - DNA, 23 bp, Artificial
  gRNA target site sequence
aactttggctcagtgcgccaggg

SEQ ID NO: 5099 - DNA, 23 bp, Artificial
  gRNA target site sequence
gtgtaccgcatgcgcaagtatgg

SEQ ID NO: 5100 - DNA, 23 bp, Artificial
  gRNA target site sequence
aagtatggccgcccctgccgtgg

SEQ ID NO: 5101 - DNA, 23 bp, Artificial
  gRNA target site sequence
tatggccgcccctgccgtggtgg

SEQ ID NO: 5102 - DNA, 23 bp, Artificial
  gRNA target site sequence
atggccgcccctgccgtggtggg

SEQ ID NO: 5103 - DNA, 23 bp, Artificial
  gRNA target site sequence
tgcgtgctgggcacacacagcgg

SEQ ID NO: 5104 - DNA, 23 bp, Artificial
  gRNA target site sequence
ctggggacgttatgcgtgctggg

SEQ ID NO: 5105 - DNA, 23 bp, Artificial
  gRNA target site sequence
tctggggacgttatgcgtgctgg

SEQ ID NO: 5106 - DNA, 23 bp, Artificial
  gRNA target site sequence
catcggccgcggtttgtctgggg

SEQ ID NO: 5107 - DNA, 23 bp, Artificial
  gRNA target site sequence
gcatcggccgcggtttgtctggg

SEQ ID NO: 5108 - DNA, 23 bp, Artificial
  gRNA target site sequence
ggcatcggccgcggtttgtctgg

SEQ ID NO: 5109 - DNA, 23 bp, Artificial
  gRNA target site sequence
gtgtccatgggcatcggccgcgg

SEQ ID NO: 5110 - DNA, 23 bp, Artificial
  gRNA target site sequence
acgctcgtgtccatgggcatcgg

SEQ ID NO: 5111 - DNA, 23 bp, Artificial
  gRNA target site sequence
tcatacacgctcgtgtccatggg

SEQ ID NO: 5112 - DNA, 23 bp, Artificial
  gRNA target site sequence
ctcatacacgctcgtgtccatgg

SEQ ID NO: 5113 - DNA, 23 bp, Artificial
  gRNA target site sequence
gctcctctgggtcgctgtagggg

SEQ ID NO: 5114 - DNA, 23 bp, Artificial
  gRNA target site sequence
agctcctctgggtcgctgtaggg

SEQ ID NO: 5115 - DNA, 23 bp, Artificial
  gRNA target site sequence
gagctcctctgggtcgctgtagg

SEQ ID NO: 5116 - DNA, 23 bp, Artificial
  gRNA target site sequence
tcttgtccttgagctcctctggg

SEQ ID NO: 5117 - DNA, 23 bp, Artificial
  gRNA target site sequence
ttcttgtccttgagctcctctgg

SEQ ID NO: 5118 - DNA, 23 bp, Artificial
  gRNA target site sequence
tgaggaggttatcgcgcttcagg

SEQ ID NO: 5119 - DNA, 23 bp, Artificial
  gRNA target site sequence
gttcaatgtcagctatgaggagg

SEQ ID NO: 5120 - DNA, 23 bp, Artificial
  gRNA target site sequence
caagttcaatgtcagctatgagg

SEQ ID NO: 5121 - DNA, 23 bp, Artificial
  gRNA target site sequence
tgcgcatgcggtacacgccctgg

SEQ ID NO: 5122 - DNA, 23 bp, Artificial
  gRNA target site sequence
ggcggccatacttgcgcatgcgg

SEQ ID NO: 5123 - DNA, 23 bp, Artificial
  gRNA target site sequence
ctcccgtggccgggtcgggcagg

SEQ ID NO: 5124 - DNA, 23 bp, Artificial
  gRNA target site sequence
gggcaggaagcagatcgacgtgg

SEQ ID NO: 5125 - DNA, 23 bp, Artificial
  gRNA target site sequence
gcagatcgacgtggccatcaagg

SEQ ID NO: 5126 - DNA, 23 bp, Artificial
  gRNA target site sequence
ggccatcaaggtgctgaagcagg

SEQ ID NO: 5127 - DNA, 23 bp, Artificial
  gRNA target site sequence
gccatcaaggtgctgaagcaggg

SEQ ID NO: 5128 - DNA, 23 bp, Artificial
  gRNA target site sequence
caaggtgctgaagcagggcacgg

SEQ ID NO: 5129 - DNA, 23 bp, Artificial
  gRNA target site sequence
gctgaagcagggcacggagaagg

SEQ ID NO: 5130 - DNA, 23 bp, Artificial
  gRNA target site sequence
gggcacggagaaggcagacacgg

SEQ ID NO: 5131 - DNA, 23 bp, Artificial
  gRNA target site sequence
cacggaagagatgatgcgcgagg

SEQ ID NO: 5132 - DNA, 23 bp, Artificial
  gRNA target site sequence
ggcgcagatcatgcaccagctgg

SEQ ID NO: 5133 - DNA, 23 bp, Artificial
  gRNA target site sequence
tggacaacccctacatcgtgcgg

SEQ ID NO: 5134 - DNA, 23 bp, Artificial
  gRNA target site sequence
ccctacatcgtgcggctcattgg

SEQ ID NO: 5135 - DNA, 23 bp, Artificial
  gRNA target site sequence
gcggctcattggcgtctgccagg

SEQ ID NO: 5136 - DNA, 23 bp, Artificial
  gRNA target site sequence
cattggcgtctgccaggccgagg

SEQ ID NO: 5137 - DNA, 23 bp, Artificial
  gRNA target site sequence
ccaggccgaggccctcatgctgg

SEQ ID NO: 5138 - DNA, 23 bp, Artificial
  gRNA target site sequence
cgaggccctcatgctggtcatgg

SEQ ID NO: 5139 - DNA, 23 bp, Artificial
  gRNA target site sequence
cctcatgctggtcatggagatgg

SEQ ID NO: 5140 - DNA, 23 bp, Artificial
  gRNA target site sequence
atgctggtcatggagatggctgg

SEQ ID NO: 5141 - DNA, 23 bp, Artificial
  gRNA target site sequence
tgctggtcatggagatggctggg

SEQ ID NO: 5142 - DNA, 23 bp, Artificial
  gRNA target site sequence
gctggtcatggagatggctgggg

SEQ ID NO: 5143 - DNA, 23 bp, Artificial
  gRNA target site sequence
ctggtcatggagatggctggggg

SEQ ID NO: 5144 - DNA, 23 bp, Artificial
  gRNA target site sequence
gtcatggagatggctgggggcgg

SEQ ID NO: 5145 - DNA, 23 bp, Artificial
  gRNA target site sequence
tcatggagatggctgggggcggg

SEQ ID NO: 5146 - DNA, 23 bp, Artificial
  gRNA target site sequence
cgggccgctgcacaagttcctgg

SEQ ID NO: 5147 - DNA, 23 bp, Artificial
  gRNA target site sequence
ccgctgcacaagttcctggtcgg

SEQ ID NO: 5148 - DNA, 23 bp, Artificial
  gRNA target site sequence
acaagttcctggtcggcaagagg

SEQ ID NO: 5149 - DNA, 23 bp, Artificial
  gRNA target site sequence
ggtcggcaagaggtgagcaccgg

SEQ ID NO: 5150 - DNA, 23 bp, Artificial
  gRNA target site sequence
gtcggcaagaggtgagcaccggg

SEQ ID NO: 5151 - DNA, 23 bp, Artificial
  gRNA target site sequence
ggcaagaggtgagcaccgggtgg

SEQ ID NO: 5152 - DNA, 23 bp, Artificial
  gRNA target site sequence
gcaagaggtgagcaccgggtggg

SEQ ID NO: 5153 - DNA, 23 bp, Artificial
  gRNA target site sequence
aggtgagcaccgggtgggcccgg

SEQ ID NO: 5154 - DNA, 23 bp, Artificial
  gRNA target site sequence
ctgcccgacccggccacgggagg

SEQ ID NO: 5155 - DNA, 23 bp, Artificial
  gRNA target site sequence
ttcctgcccgacccggccacggg

SEQ ID NO: 5156 - DNA, 23 bp, Artificial
  gRNA target site sequence
cttcctgcccgacccggccacgg

SEQ ID NO: 5157 - DNA, 23 bp, Artificial
  gRNA target site sequence
gatctgcttcctgcccgacccgg

SEQ ID NO: 5158 - DNA, 23 bp, Artificial
  gRNA target site sequence
gccctgcttcagcaccttgatgg

SEQ ID NO: 5159 - DNA, 23 bp, Artificial
  gRNA target site sequence
cgatgtaggggttgtccagctgg

SEQ ID NO: 5160 - DNA, 23 bp, Artificial
  gRNA target site sequence
caatgagccgcacgatgtagggg

SEQ ID NO: 5161 - DNA, 23 bp, Artificial
  gRNA target site sequence
ccaatgagccgcacgatgtaggg

SEQ ID NO: 5162 - DNA, 23 bp, Artificial
  gRNA target site sequence
gccaatgagccgcacgatgtagg

SEQ ID NO: 5163 - DNA, 23 bp, Artificial
  gRNA target site sequence
ccagcatgagggcctcggcctgg

SEQ ID NO: 5164 - DNA, 23 bp, Artificial
  gRNA target site sequence
catgaccagcatgagggcctcgg

SEQ ID NO: 5165 - DNA, 23 bp, Artificial
  gRNA target site sequence
catctccatgaccagcatgaggg

SEQ ID NO: 5166 - DNA, 23 bp, Artificial
  gRNA target site sequence
ccatctccatgaccagcatgagg

SEQ ID NO: 5167 - DNA, 23 bp, Artificial
  gRNA target site sequence
ccgaccaggaacttgtgcagcgg

SEQ ID NO: 5168 - DNA, 23 bp, Artificial
  gRNA target site sequence
gtgctcacctcttgccgaccagg

SEQ ID NO: 5169 - DNA, 23 bp, Artificial
  gRNA target site sequence
cccgccttccccgccaccccagg

SEQ ID NO: 5170 - DNA, 23 bp, Artificial
  gRNA target site sequence
ccgccttccccgccaccccaggg

SEQ ID NO: 5171 - DNA, 23 bp, Artificial
  gRNA target site sequence
ccttccccgccaccccagggagg

SEQ ID NO: 5172 - DNA, 23 bp, Artificial
  gRNA target site sequence
ggagatccctgtgagcaatgtgg

SEQ ID NO: 5173 - DNA, 23 bp, Artificial
  gRNA target site sequence
tgtggccgagctgctgcaccagg

SEQ ID NO: 5174 - DNA, 23 bp, Artificial
  gRNA target site sequence
gctgctgcaccaggtgtccatgg

SEQ ID NO: 5175 - DNA, 23 bp, Artificial
  gRNA target site sequence
ctgctgcaccaggtgtccatggg

SEQ ID NO: 5176 - DNA, 23 bp, Artificial
  gRNA target site sequence
tgctgcaccaggtgtccatgggg

SEQ ID NO: 5177 - DNA, 23 bp, Artificial
  gRNA target site sequence
gtccatggggatgaagtacctgg

SEQ ID NO: 5178 - DNA, 23 bp, Artificial
  gRNA target site sequence
catggggatgaagtacctggagg

SEQ ID NO: 5179 - DNA, 23 bp, Artificial
  gRNA target site sequence
gaactttgtgcaccgtgacctgg

SEQ ID NO: 5180 - DNA, 23 bp, Artificial
  gRNA target site sequence
ctttgtgcaccgtgacctggcgg

SEQ ID NO: 5181 - DNA, 23 bp, Artificial
  gRNA target site sequence
ggcggcccgcaacgtcctgctgg

SEQ ID NO: 5182 - DNA, 23 bp, Artificial
  gRNA target site sequence
gcaacgtcctgctggttaaccgg

SEQ ID NO: 5183 - DNA, 23 bp, Artificial
  gRNA target site sequence
tacgccaagatcagcgactttgg

SEQ ID NO: 5184 - DNA, 23 bp, Artificial
  gRNA target site sequence
ctttggcctctccaaagcactgg

SEQ ID NO: 5185 - DNA, 23 bp, Artificial
  gRNA target site sequence
tttggcctctccaaagcactggg

SEQ ID NO: 5186 - DNA, 23 bp, Artificial
  gRNA target site sequence
ctggggtggcggggaaggcgggg

SEQ ID NO: 5187 - DNA, 23 bp, Artificial
  gRNA target site sequence
cctggggtggcggggaaggcggg

SEQ ID NO: 5188 - DNA, 23 bp, Artificial
  gRNA target site sequence
ccctggggtggcggggaaggcgg

SEQ ID NO: 5189 - DNA, 23 bp, Artificial
  gRNA target site sequence
cctccctggggtggcggggaagg

SEQ ID NO: 5190 - DNA, 23 bp, Artificial
  gRNA target site sequence
atctcctccctggggtggcgggg

SEQ ID NO: 5191 - DNA, 23 bp, Artificial
  gRNA target site sequence
gatctcctccctggggtggcggg

SEQ ID NO: 5192 - DNA, 23 bp, Artificial
  gRNA target site sequence
ggatctcctccctggggtggcgg

SEQ ID NO: 5193 - DNA, 23 bp, Artificial
  gRNA target site sequence
cagggatctcctccctggggtgg

SEQ ID NO: 5194 - DNA, 23 bp, Artificial
  gRNA target site sequence
tcacagggatctcctccctgggg

SEQ ID NO: 5195 - DNA, 23 bp, Artificial
  gRNA target site sequence
ctcacagggatctcctccctggg

SEQ ID NO: 5196 - DNA, 23 bp, Artificial
  gRNA target site sequence
gctcacagggatctcctccctgg

SEQ ID NO: 5197 - DNA, 23 bp, Artificial
  gRNA target site sequence
gctcggccacattgctcacaggg

SEQ ID NO: 5198 - DNA, 23 bp, Artificial
  gRNA target site sequence
agctcggccacattgctcacagg

SEQ ID NO: 5199 - DNA, 23 bp, Artificial
  gRNA target site sequence
ggacacctggtgcagcagctcgg

SEQ ID NO: 5200 - DNA, 23 bp, Artificial
  gRNA target site sequence
acttcatccccatggacacctgg

SEQ ID NO: 5201 - DNA, 23 bp, Artificial
  gRNA target site sequence
ctccaggtacttcatccccatgg

SEQ ID NO: 5202 - DNA, 23 bp, Artificial
  gRNA target site sequence
gcacaaagttcttctcctccagg

SEQ ID NO: 5203 - DNA, 23 bp, Artificial
  gRNA target site sequence
cgttgcgggccgccaggtcacgg

SEQ ID NO: 5204 - DNA, 23 bp, Artificial
  gRNA target site sequence
gcaggacgttgcgggccgccagg

SEQ ID NO: 5205 - DNA, 23 bp, Artificial
  gRNA target site sequence
gttaaccagcaggacgttgcggg

SEQ ID NO: 5206 - DNA, 23 bp, Artificial
  gRNA target site sequence
ggttaaccagcaggacgttgcgg

SEQ ID NO: 5207 - DNA, 23 bp, Artificial
  gRNA target site sequence
cgtagtgccggttaaccagcagg

SEQ ID NO: 5208 - DNA, 23 bp, Artificial
  gRNA target site sequence
cgctgatcttggcgtagtgccgg

SEQ ID NO: 5209 - DNA, 23 bp, Artificial
  gRNA target site sequence
gaggccaaagtcgctgatcttgg

SEQ ID NO: 5210 - DNA, 23 bp, Artificial
  gRNA target site sequence
cggcacccagtgctttggagagg

SEQ ID NO: 5211 - DNA, 23 bp, Artificial
  gRNA target site sequence
gtcgtcggcacccagtgctttgg

SEQ ID NO: 5212 - DNA, 23 bp, Artificial
  gRNA target site sequence
tacagtgtagtagctgtcgtcgg

SEQ ID NO: 5213 - DNA, 23 bp, Artificial
  gRNA target site sequence
agcagcatctccccctccccagg

SEQ ID NO: 5214 - DNA, 23 bp, Artificial
  gRNA target site sequence
cctccccaggcccgctcagcagg

SEQ ID NO: 5215 - DNA, 23 bp, Artificial
  gRNA target site sequence
ctccccaggcccgctcagcaggg

SEQ ID NO: 5216 - DNA, 23 bp, Artificial
  gRNA target site sequence
aggcccgctcagcagggaagtgg

SEQ ID NO: 5217 - DNA, 23 bp, Artificial
  gRNA target site sequence
cagggaagtggccgctcaagtgg

SEQ ID NO: 5218 - DNA, 23 bp, Artificial
  gRNA target site sequence
tctccagccgcagcgatgtctgg

SEQ ID NO: 5219 - DNA, 23 bp, Artificial
  gRNA target site sequence
cgcagcgatgtctggagctatgg

SEQ ID NO: 5220 - DNA, 23 bp, Artificial
  gRNA target site sequence
gcagcgatgtctggagctatggg

SEQ ID NO: 5221 - DNA, 23 bp, Artificial
  gRNA target site sequence
cagcgatgtctggagctatgggg

SEQ ID NO: 5222 - DNA, 23 bp, Artificial
  gRNA target site sequence
ggagctatggggtcaccatgtgg

SEQ ID NO: 5223 - DNA, 23 bp, Artificial
  gRNA target site sequence
gagctatggggtcaccatgtggg

SEQ ID NO: 5224 - DNA, 23 bp, Artificial
  gRNA target site sequence
ctatggggtcaccatgtgggagg

SEQ ID NO: 5225 - DNA, 23 bp, Artificial
  gRNA target site sequence
atgtgggaggccttgtcctacgg

SEQ ID NO: 5226 - DNA, 23 bp, Artificial
  gRNA target site sequence
ctacggccagaagccctacaagg

SEQ ID NO: 5227 - DNA, 23 bp, Artificial
  gRNA target site sequence
ggccagaagccctacaaggcagg

SEQ ID NO: 5228 - DNA, 23 bp, Artificial
  gRNA target site sequence
gaagccctacaaggcaggcgcgg

SEQ ID NO: 5229 - DNA, 23 bp, Artificial
  gRNA target site sequence
aagccctacaaggcaggcgcggg

SEQ ID NO: 5230 - DNA, 23 bp, Artificial
  gRNA target site sequence
tacaaggcaggcgcgggcagagg

SEQ ID NO: 5231 - DNA, 23 bp, Artificial
  gRNA target site sequence
aggcaggcgcgggcagaggcagg

SEQ ID NO: 5232 - DNA, 23 bp, Artificial
  gRNA target site sequence
caggcgcgggcagaggcaggtgg

SEQ ID NO: 5233 - DNA, 23 bp, Artificial
  gRNA target site sequence
aggcgcgggcagaggcaggtggg

SEQ ID NO: 5234 - DNA, 23 bp, Artificial
  gRNA target site sequence
tggggagggggagatgctgctgg

SEQ ID NO: 5235 - DNA, 23 bp, Artificial
  gRNA target site sequence
gctgagcgggcctggggaggggg

SEQ ID NO: 5236 - DNA, 23 bp, Artificial
  gRNA target site sequence
tgctgagcgggcctggggagggg

SEQ ID NO: 5237 - DNA, 23 bp, Artificial
  gRNA target site sequence
ctgctgagcgggcctggggaggg

SEQ ID NO: 5238 - DNA, 23 bp, Artificial
  gRNA target site sequence
cctgctgagcgggcctggggagg

SEQ ID NO: 5239 - DNA, 23 bp, Artificial
  gRNA target site sequence
ttccctgctgagcgggcctgggg

SEQ ID NO: 5240 - DNA, 23 bp, Artificial
  gRNA target site sequence
cttccctgctgagcgggcctggg

SEQ ID NO: 5241 - DNA, 23 bp, Artificial
  gRNA target site sequence
acttccctgctgagcgggcctgg

SEQ ID NO: 5242 - DNA, 23 bp, Artificial
  gRNA target site sequence
cggccacttccctgctgagcggg

SEQ ID NO: 5243 - DNA, 23 bp, Artificial
  gRNA target site sequence
gcggccacttccctgctgagcgg

SEQ ID NO: 5244 - DNA, 23 bp, Artificial
  gRNA target site sequence
tcgggtgcgtaccacttgagcgg

SEQ ID NO: 5245 - DNA, 23 bp, Artificial
  gRNA target site sequence
ttgcggaagttgatgcattcggg

SEQ ID NO: 5246 - DNA, 23 bp, Artificial
  gRNA target site sequence
cttgcggaagttgatgcattcgg

SEQ ID NO: 5247 - DNA, 23 bp, Artificial
  gRNA target site sequence
cgctgcggctggagaacttgcgg

SEQ ID NO: 5248 - DNA, 23 bp, Artificial
  gRNA target site sequence
gctccagacatcgctgcggctgg

SEQ ID NO: 5249 - DNA, 23 bp, Artificial
  gRNA target site sequence
catagctccagacatcgctgcgg

SEQ ID NO: 5250 - DNA, 23 bp, Artificial
  gRNA target site sequence
gtaggacaaggcctcccacatgg

SEQ ID NO: 5251 - DNA, 23 bp, Artificial
  gRNA target site sequence
gggcttctggccgtaggacaagg

SEQ ID NO: 5252 - DNA, 23 bp, Artificial
  gRNA target site sequence
cttgtagggcttctggccgtagg

SEQ ID NO: 5253 - DNA, 23 bp, Artificial
  gRNA target site sequence
cgcctgccttgtagggcttctgg

SEQ ID NO: 5254 - DNA, 23 bp, Artificial
  gRNA target site sequence
ctgcccgcgcctgccttgtaggg

SEQ ID NO: 5255 - DNA, 23 bp, Artificial
  gRNA target site sequence
tctgcccgcgcctgccttgtagg

SEQ ID NO: 5256 - DNA, 23 bp, Artificial
  gRNA target site sequence
cggcttgagcagaagatgaaagg

SEQ ID NO: 5257 - DNA, 23 bp, Artificial
  gRNA target site sequence
ggcttgagcagaagatgaaaggg

SEQ ID NO: 5258 - DNA, 23 bp, Artificial
  gRNA target site sequence
tgagcagaagatgaaagggccgg

SEQ ID NO: 5259 - DNA, 23 bp, Artificial
  gRNA target site sequence
gcagaagatgaaagggccggagg

SEQ ID NO: 5260 - DNA, 23 bp, Artificial
  gRNA target site sequence
gatgaaagggccggaggtcatgg

SEQ ID NO: 5261 - DNA, 23 bp, Artificial
  gRNA target site sequence
ggtcatggccttcatcgagcagg

SEQ ID NO: 5262 - DNA, 23 bp, Artificial
  gRNA target site sequence
gtcatggccttcatcgagcaggg

SEQ ID NO: 5263 - DNA, 23 bp, Artificial
  gRNA target site sequence
ccttcatcgagcagggcaagcgg

SEQ ID NO: 5264 - DNA, 23 bp, Artificial
  gRNA target site sequence
catcgagcagggcaagcggatgg

SEQ ID NO: 5265 - DNA, 23 bp, Artificial
  gRNA target site sequence
acgcactcatgagtgactgctgg

SEQ ID NO: 5266 - DNA, 23 bp, Artificial
  gRNA target site sequence
gatctacaagtgagtgccagtgg

SEQ ID NO: 5267 - DNA, 23 bp, Artificial
  gRNA target site sequence
atctacaagtgagtgccagtggg

SEQ ID NO: 5268 - DNA, 23 bp, Artificial
  gRNA target site sequence
tctacaagtgagtgccagtgggg

SEQ ID NO: 5269 - DNA, 23 bp, Artificial
  gRNA target site sequence
acaagtgagtgccagtggggagg

SEQ ID NO: 5270 - DNA, 23 bp, Artificial
  gRNA target site sequence
caagtgagtgccagtggggaggg

SEQ ID NO: 5271 - DNA, 23 bp, Artificial
  gRNA target site sequence
aagtgagtgccagtggggagggg

SEQ ID NO: 5272 - DNA, 23 bp, Artificial
  gRNA target site sequence
ttcatcttctgctcaagccgggg

SEQ ID NO: 5273 - DNA, 23 bp, Artificial
  gRNA target site sequence
tttcatcttctgctcaagccggg

SEQ ID NO: 5274 - DNA, 23 bp, Artificial
  gRNA target site sequence
ctttcatcttctgctcaagccgg

SEQ ID NO: 5275 - DNA, 23 bp, Artificial
  gRNA target site sequence
tcgatgaaggccatgacctccgg

SEQ ID NO: 5276 - DNA, 23 bp, Artificial
  gRNA target site sequence
ccgcttgccctgctcgatgaagg

SEQ ID NO: 5277 - DNA, 23 bp, Artificial
  gRNA target site sequence
gttcgggtggacactctggtggg

SEQ ID NO: 5278 - DNA, 23 bp, Artificial
  gRNA target site sequence
agttcgggtggacactctggtgg

SEQ ID NO: 5279 - DNA, 23 bp, Artificial
  gRNA target site sequence
tacagttcgggtggacactctgg

SEQ ID NO: 5280 - DNA, 23 bp, Artificial
  gRNA target site sequence
atgagtgcgtacagttcgggtgg

SEQ ID NO: 5281 - DNA, 23 bp, Artificial
  gRNA target site sequence
ctcatgagtgcgtacagttcggg

SEQ ID NO: 5282 - DNA, 23 bp, Artificial
  gRNA target site sequence
actcatgagtgcgtacagttcgg

SEQ ID NO: 5283 - DNA, 23 bp, Artificial
  gRNA target site sequence
ggatgtaccccacgccccacagg

SEQ ID NO: 5284 - DNA, 23 bp, Artificial
  gRNA target site sequence
tgtaccccacgccccacaggtgg

SEQ ID NO: 5285 - DNA, 23 bp, Artificial
  gRNA target site sequence
gtaccccacgccccacaggtggg

SEQ ID NO: 5286 - DNA, 23 bp, Artificial
  gRNA target site sequence
ccccacgccccacaggtgggagg

SEQ ID NO: 5287 - DNA, 23 bp, Artificial
  gRNA target site sequence
tcgccccgacttcctgaccgtgg

SEQ ID NO: 5288 - DNA, 23 bp, Artificial
  gRNA target site sequence
gcgagcctgttactacagcctgg

SEQ ID NO: 5289 - DNA, 23 bp, Artificial
  gRNA target site sequence
ttactacagcctggccagcaagg

SEQ ID NO: 5290 - DNA, 23 bp, Artificial
  gRNA target site sequence
ctacagcctggccagcaaggtgg

SEQ ID NO: 5291 - DNA, 23 bp, Artificial
  gRNA target site sequence
agcctggccagcaaggtggaagg

SEQ ID NO: 5292 - DNA, 23 bp, Artificial
  gRNA target site sequence
gcctggccagcaaggtggaaggg

SEQ ID NO: 5293 - DNA, 23 bp, Artificial
  gRNA target site sequence
agcaaggtggaagggcccccagg

SEQ ID NO: 5294 - DNA, 23 bp, Artificial
  gRNA target site sequence
gcccccaggcagcacacagaagg

SEQ ID NO: 5295 - DNA, 23 bp, Artificial
  gRNA target site sequence
aggcagcacacagaaggctgagg

SEQ ID NO: 5296 - DNA, 23 bp, Artificial
  gRNA target site sequence
tgcctgagctcccgctgcccagg

SEQ ID NO: 5297 - DNA, 23 bp, Artificial
  gRNA target site sequence
gcctgagctcccgctgcccaggg

SEQ ID NO: 5298 - DNA, 23 bp, Artificial
  gRNA target site sequence
cctgagctcccgctgcccagggg

SEQ ID NO: 5299 - DNA, 23 bp, Artificial
  gRNA target site sequence
gtggggcgtggggtacatccagg

SEQ ID NO: 5300 - DNA, 23 bp, Artificial
  gRNA target site sequence
cctcccacctgtggggcgtgggg

SEQ ID NO: 5301 - DNA, 23 bp, Artificial
  gRNA target site sequence
tcctcccacctgtggggcgtggg

SEQ ID NO: 5302 - DNA, 23 bp, Artificial
  gRNA target site sequence
atcctcccacctgtggggcgtgg

SEQ ID NO: 5303 - DNA, 23 bp, Artificial
  gRNA target site sequence
gggcgatcctcccacctgtgggg

SEQ ID NO: 5304 - DNA, 23 bp, Artificial
  gRNA target site sequence
ggggcgatcctcccacctgtggg

SEQ ID NO: 5305 - DNA, 23 bp, Artificial
  gRNA target site sequence
cggggcgatcctcccacctgtgg

SEQ ID NO: 5306 - DNA, 23 bp, Artificial
  gRNA target site sequence
gctccacggtcaggaagtcgggg

SEQ ID NO: 5307 - DNA, 23 bp, Artificial
  gRNA target site sequence
tgctccacggtcaggaagtcggg

SEQ ID NO: 5308 - DNA, 23 bp, Artificial
  gRNA target site sequence
ctgctccacggtcaggaagtcgg

SEQ ID NO: 5309 - DNA, 23 bp, Artificial
  gRNA target site sequence
gcatgcgctgctccacggtcagg

SEQ ID NO: 5310 - DNA, 23 bp, Artificial
  gRNA target site sequence
ggctcgcatgcgctgctccacgg

SEQ ID NO: 5311 - DNA, 23 bp, Artificial
  gRNA target site sequence
gctggccaggctgtagtaacagg

SEQ ID NO: 5312 - DNA, 23 bp, Artificial
  gRNA target site sequence
gcccttccaccttgctggccagg

SEQ ID NO: 5313 - DNA, 23 bp, Artificial
  gRNA target site sequence
tgggggcccttccaccttgctgg

SEQ ID NO: 5314 - DNA, 23 bp, Artificial
  gRNA target site sequence
gccttctgtgtgctgcctggggg

SEQ ID NO: 5315 - DNA, 23 bp, Artificial
  gRNA target site sequence
agccttctgtgtgctgcctgggg

SEQ ID NO: 5316 - DNA, 23 bp, Artificial
  gRNA target site sequence
cagccttctgtgtgctgcctggg

SEQ ID NO: 5317 - DNA, 23 bp, Artificial
  gRNA target site sequence
tcagccttctgtgtgctgcctgg

SEQ ID NO: 5318 - DNA, 23 bp, Artificial
  gRNA target site sequence
ggcagcgggagctcaggcacagg

SEQ ID NO: 5319 - DNA, 23 bp, Artificial
  gRNA target site sequence
cccctgggcagcgggagctcagg

SEQ ID NO: 5320 - protein, 1368 aa, Artificial [sequence omitted]

SEQ ID NO: 5321 - DNA, 23 bp, Artificial
  gRNA target site sequence
gtaacggcagacttctccacagg

SEQ ID NO: 5322 - DNA, 20 bp, Artificial
  gRNA target site sequence
gtaacggcagacttctccac

SEQ ID NO: 5323 - DNA, 23 bp, Artificial
  gRNA target site sequence
gatgctcagtacagccaccttgg

SEQ ID NO: 5324 - DNA, 20 bp, Artificial
  gRNA target site sequence
gatgctcagtacagccacct

SEQ ID NO: 5325 - DNA, 23 bp, Artificial
  gRNA target site sequence
gatgctcagtacagccaccttgg

SEQ ID NO: 5326 - DNA, 20 bp, Artificial
  gRNA target site sequence
gatgctgagtacagccacct

SEQ ID NO: 5327 - DNA, 12 bp, Artificial
  gRNA target site sequence fragment
gtacagccacct

SEQ ID NO: 5328 - DNA, 13 bp, Artificial
  gRNA target site sequence fragment
agtacagccacct

SEQ ID NO: 5329 - DNA, 14 bp, Artificial
  gRNA target site sequence fragment
cagtacagccacct

SEQ ID NO: 5330 - DNA, 15 bp, Artificial
  gRNA target site sequence fragment
tcagtacagccacct

SEQ ID NO: 5331 - DNA, 16 bp, Artificial
  gRNA target site sequence fragment
ctcagtacagccacct

SEQ ID NO: 5332 - DNA, 17 bp, Artificial
  gRNA target site sequence fragment
gctcagtacagccacct

SEQ ID NO: 5333 - DNA, 18 bp, Artificial
  gRNA target site sequence fragment
tgctcagtacagccacct

SEQ ID NO: 5334 - DNA, 19 bp, Artificial
  gRNA target site sequence fragment
atgctcagtacagccacct

SEQ ID NO: 5335 - DNA, 23 bp, Artificial
  target sequence
gctgccgcccagtgggactttgg

SEQ ID NO: 5336 - DNA, 23 bp, Artificial
  target sequence
actgtctccctgtagaaaactgg

SEQ ID NO: 5337 - DNA, 23 bp, Artificial
  target sequence
gatctggtaaagatgattcctgg

SEQ ID NO: 5338 - DNA, 23 bp, Artificial
  target sequence
catttagtaaagatgattcctgg

SEQ ID NO: 5339 - DNA, 23 bp, Artificial
  target sequence
acaatgtgtcaactcttgacagg

SEQ ID NO: 5340 - DNA, 21 bp, Artificial
  target sequence
gcattttctgttctctgaagt

SEQ ID NO: 5341 - DNA, 22 bp, Artificial
  target sequence
tcactatgctgccgcccagtgg

SEQ ID NO: 5342 - DNA, 22 bp, Artificial
  target sequence
tcactaggcatgctgccagagc

SEQ ID NO: 5343 - DNA, 23 bp, Artificial
  target sequence
gctgtgtttgcgtctctcccagg

SEQ ID NO: 5344 - DNA, 23 bp, Artificial
  target sequence
gctgtgtttgcttctgtcccagg

SEQ ID NO: 5345 - DNA, 15 bp, Homo sapiens
ggcaaccctaaggtg

SEQ ID NO: 5346 - DNA, 11 bp, Homo sapiens
acgttctctga

SEQ ID NO: 5347 - DNA, 12 bp, Homo sapiens
ccaccaccagtg

SEQ ID NO: 5348 - DNA, 12 bp, Homo sapiens
ccaccaccagtg

SEQ ID NO: 5349 - protein, 6 aa, Homo sapiens
VNAATN

SEQ ID NO: 5350 - DNA, 18 bp, Homo sapiens
gtgcaggctgcctatcag

SEQ ID NO: 5351 - DNA, 11 bp, Homo sapiens
aaagtggtggc

SEQ ID NO: 5352 - DNA, 12 bp, Homo sapiens
gtggctggtgtg

SEQ ID NO: 5353 - DNA, 12 bp, Homo sapiens
gtggctggtgtg

SEQ ID NO: 5354 - protein, 4 aa, Homo sapiens
VAGV

SEQ ID NO: 5355 - DNA, 13 bp, Homo sapiens
gcatctggattct

SEQ ID NO: 5356 - DNA, 23 bp, Artificial
  target sequence
ctccctgggctgcaccatagtga

SEQ ID NO: 5357 - DNA, 23 bp, Artificial
  target sequence
gaccttgtgaagatgattcctgg

SEQ ID NO: 5358 - DNA, 23 bp, Artificial
  target sequence
gatctggggaagaggattccagg

SEQ ID NO: 5359 - DNA, 23 bp, Artificial
  target sequence
agattgtgtatactcttgactag

SEQ ID NO: 5360 - DNA, 23 bp, Artificial
  target sequence
ccaggaatcatctctacgatatc

SEQ ID NO: 5361 - DNA, 23 bp, Artificial
  target sequence
ccaggaatcatctctacgatatc

SEQ ID NO: 5362 - DNA, 23 bp, Artificial
  target sequence
cctggaattctctttactagatc

SEQ ID NO: 5363 - DNA, 23 bp, Artificial
  target sequence
ccggggagaggcgcggacacagc

SEQ ID NO: 5364 - DNA, 23 bp, Artificial
  target sequence
ccagggagagacggaaccaaaac

SEQ ID NO: 5365 - DNA, 23 bp, Artificial
  target sequence
gatctgatacagatgattcatgg

SEQ ID NO: 5366 - DNA, 23 bp, Artificial
  target sequence
ctgggaatcatctttacaagatg

SEQ ID NO: 5367 - DNA, 23 bp, Artificial
  target sequence
tgaatatcctgtcgcccagtcag

SEQ ID NO: 5368 - DNA, 23 bp, Artificial
  target sequence
ccacccaagtgatcactcttcct

SEQ ID NO: 5369 - DNA, 23 bp, Artificial
  target sequence
aggaagagtgatcacttgggtgg

SEQ ID NO: 5370 - DNA, 23 bp, Artificial
  target sequence
tctgtgtttttgtctctccccag

SEQ ID NO: 5371 - DNA, 23 bp, Artificial
  target sequence
tctgtgtttttgtctctccccag

SEQ ID NO: 5372 - DNA, 23 bp, Artificial
  target sequence
aggaagagtgatcacttgggtgg

SEQ ID NO: 5373 - DNA, 23 bp, Artificial
  target sequence
ccacccaagtgatcactcttcct

SEQ ID NO: 5374 - DNA, 23 bp, Artificial
  target sequence
ctaggaatcatcttccccagatg

SEQ ID NO: 5375 - DNA, 23 bp, Artificial
  target sequence
tctgtggaaaagatgattccaag

SEQ ID NO: 5376 - DNA, 23 bp, Artificial
  target sequence
gttcttgttaagatgattcctgg

SEQ ID NO: 5377 - DNA, 23 bp, Artificial
  target sequence
gttcttgttaagatgattcctgg

SEQ ID NO: 5378 - DNA, 23 bp, Artificial
  target sequence
ggcatgtttcatcacttgggggg

SEQ ID NO: 5379 - DNA, 23 bp, Artificial
  target sequence
gggctggtaaagatgtttccagg

SEQ ID NO: 5380 - DNA, 23 bp, Artificial
  target sequence
gacaagtgtgatcacctggttgg

SEQ ID NO: 5381 - DNA, 23 bp, Artificial
  target sequence
gctgtgtttgcttctgtcccagg

SEQ ID NO: 5382 - DNA, 23 bp, Artificial
  target sequence
ccaggaatcatctttactaaatg

SEQ ID NO: 5383 - DNA, 23 bp, Artificial
  target sequence
ccaggaatcatctttactaaatg

SEQ ID NO: 5384 - DNA, 23 bp, Artificial
  target sequence
tcactatgctgccgcccagtggg

SEQ ID NO: 5385 - DNA, 23 bp, Artificial
  target sequence
gctgccgcccagtgggactttgg

SEQ ID NO: 5386 - DNA, 23 bp, Artificial
  target sequence
acaatgtgtcaactcttgacagg

SEQ ID NO: 5387 - DNA, 23 bp, Artificial
  target sequence
gacaagtgtgatcacttgggtgg

SEQ ID NO: 5388 - DNA, 23 bp, Artificial
  target sequence
gctgtgtttgcgtctctcccagg

SEQ ID NO: 5389 - DNA, 23 bp, Artificial
  target sequence
ccaggaatcatctttaccagatc

SEQ ID NO: 5390 - DNA, 23 bp, Artificial
  target sequence
acaaggggtcaactctggacaag

SEQ ID NO: 5391 - DNA, 23 bp, Artificial
  target sequence
acaaggggtcaactctggacaag

SEQ ID NO: 5392 - DNA, 23 bp, Artificial
  target sequence
cccactgggctgcagcatcctgg

SEQ ID NO: 5393 - DNA, 23 bp, Artificial
  target sequence
ccagcgcgtgacgcaaacacagc

SEQ ID NO: 5394 - DNA, 23 bp, Artificial
  target sequence
acaatgtgtcaccttttaactgg

SEQ ID NO: 5395 - DNA, 23 bp, Artificial
  target sequence
acaatatttcaacacttgacaag

SEQ ID NO: 5396 - DNA, 23 bp, Artificial
  target sequence
cttggagtcatctttgccacatc

SEQ ID NO: 5397 - DNA, 23 bp, Artificial
  target sequence
gacaagcgtgatcccatggggag

SEQ ID NO: 5398 - DNA, 23 bp, Artificial
  target sequence
cctcccaagtaatcacccttttc

SEQ ID NO: 5399 - DNA, 23 bp, Artificial
  target sequence
cccaagtcccactggcaggtggc

SEQ ID NO: 5400 - DNA, 23 bp, Artificial
  target sequence
gctatgtgttaactcttgacaag

SEQ ID NO: 5401 - DNA, 23 bp, Artificial
  target sequence
gctatgtgttaactcttgacaag

SEQ ID NO: 5402 - DNA, 23 bp, Artificial
  target sequence
ccactatggtgcctcccagtcag

SEQ ID NO: 5403 - DNA, 23 bp, Artificial
  target sequence
tcactctgctgctgtccagtggg

SEQ ID NO: 5404 - DNA, 23 bp, Artificial
  target sequence
actctgtcctgccgcccagtgag

SEQ ID NO: 5405 - DNA, 23 bp, Artificial
  target sequence
cttggaatcatctctacctgatt

SEQ ID NO: 5406 - DNA, 23 bp, Artificial
  target sequence
cccaagtcccactgggtgacatg

SEQ ID NO: 5407 - DNA, 23 bp, Artificial
  target sequence
ctaaggagagaggcacacacagc

SEQ ID NO: 5408 - DNA, 23 bp, Artificial
  target sequence
ccagggagggacgcaaacccagc

SEQ ID NO: 5409 - DNA, 23 bp, Artificial
  target sequence
ccagggagggacgcaaacccagc

SEQ ID NO: 5410 - DNA, 23 bp, Artificial
  target sequence
cttctcaagtgatcccactggtc

SEQ ID NO: 5411 - DNA, 23 bp, Artificial
  target sequence
cctgagagagaagcaaacacaga

SEQ ID NO: 5412 - DNA, 23 bp, Artificial
  target sequence
cttaggaaagacgcaaacatagc

SEQ ID NO: 5413 - DNA, 23 bp, Artificial
  target sequence
acattgattaaactcttgactag

SEQ ID NO: 5414 - DNA, 23 bp, Artificial
  target sequence
acaaagtttaaactcttgagcag

SEQ ID NO: 5415 - DNA, 23 bp, Artificial
  target sequence
cttcccaagtgattacactttat

SEQ ID NO: 5416 - DNA, 23 bp, Artificial
  target sequence
cccactggggcgcagcctagtga

SEQ ID NO: 5417 - DNA, 23 bp, Artificial
  target sequence
cttgtcaagatttgccacattat

SEQ ID NO: 5418 - DNA, 23 bp, Artificial
  target sequence
cttgtcaagatttgccacattat

SEQ ID NO: 5419 - DNA, 23 bp, Artificial
  target sequence
ccttggtgagaggcaaacacagc

SEQ ID NO: 5420 - DNA, 23 bp, Artificial
  target sequence
cctactgggcgtcagcactgtgt

SEQ ID NO: 5421 - DNA, 23 bp, Artificial
  target sequence
tcactatgcagcaccccagtggg

SEQ ID NO: 5422 - DNA, 23 bp, Artificial
  target sequence
ccaggcatcttctttaccagctc

SEQ ID NO: 5423 - DNA, 23 bp, Artificial
  target sequence
ctcactgggctgcagcattgggg

SEQ ID NO: 5424 - DNA, 23 bp, Artificial
  target sequence
ccagggagagacgcagaaacaac

SEQ ID NO: 5425 - DNA, 23 bp, Artificial
  target sequence
ccagggagagacgcagaaacaac

SEQ ID NO: 5426 - DNA, 23 bp, Artificial
  target sequence
tacatgagtaatcacttggggag

SEQ ID NO: 5427 - DNA, 23 bp, Artificial
  target sequence
ctccccaagtgattactcatgta

SEQ ID NO: 5428 - DNA, 23 bp, Artificial
  target sequence
ctccccaagtgattactcatgta

SEQ ID NO: 5429 - DNA, 23 bp, Artificial
  target sequence
tacatgagtaatcacttggggag

SEQ ID NO: 5430 - DNA, 23 bp, Artificial
  target sequence
ctccccaagtgattactcatgta

SEQ ID NO: 5431 - DNA, 23 bp, Artificial
  target sequence
ctccccaagtgattactcatgta

SEQ ID NO: 5432 - DNA, 23 bp, Artificial
  target sequence
tacatgagtaatcacttggggag

SEQ ID NO: 5433 - DNA, 23 bp, Artificial
  target sequence
ctccccaagtgattactcatgta

SEQ ID NO: 5434 - DNA, 23 bp, Artificial
  target sequence
ctccccaagtgattactcatgta

SEQ ID NO: 5435 - DNA, 23 bp, Artificial
  target sequence
tacatgagtaatcacttggggag

SEQ ID NO: 5436 - DNA, 23 bp, Artificial
  target sequence
ctccccaagtgattactcatgta

SEQ ID NO: 5437 - DNA, 23 bp, Artificial
  target sequence
ctccccaagtgattactcatgta

SEQ ID NO: 5438 - DNA, 23 bp, Artificial
  target sequence
cagaggtgtgatcacttgggcag

SEQ ID NO: 5439 - DNA, 23 bp, Artificial
  target sequence
cagaggtgtgatcacttgggcag

SEQ ID NO: 5440 - DNA, 23 bp, Artificial
  target sequence
cttcccatgtgataacacttgtc

SEQ ID NO: 5441 - DNA, 23 bp, Artificial
  target sequence
cttcccatgtgataacacttgtc

SEQ ID NO: 5442 - DNA, 23 bp, Artificial
  target sequence
cctgagagagaggcaaacacatc

SEQ ID NO: 5443 - DNA, 23 bp, Artificial
  target sequence
ccacgaatcctctttaccaaatc

SEQ ID NO: 5444 - DNA, 23 bp, Artificial
  target sequence
ctccccaagtgattactcatgta

SEQ ID NO: 5445 - DNA, 23 bp, Artificial
  target sequence
tacatgagtaatcacttggggag

SEQ ID NO: 5446 - DNA, 23 bp, Artificial
  target sequence
ctccccaagtgattactcatgta

SEQ ID NO: 5447 - DNA, 23 bp, Artificial
  target sequence
cctgagggtgcgtctctcccggg

SEQ ID NO: 5448 - DNA, 23 bp, Artificial
  target sequence
gctgtgtgctcgtctctccctgg

SEQ ID NO: 5449 - DNA, 23 bp, Artificial
  target sequence
gctgtgtgctcgtctctccctgg

SEQ ID NO: 5450 - DNA, 23 bp, Artificial
  target sequence
gctgcggcccagcgggacctggg

SEQ ID NO: 5451 - DNA, 23 bp, Artificial
  target sequence
gctgtacttgggtctctccccag

SEQ ID NO: 5452 - DNA, 23 bp, Artificial
  target sequence
gccgtgttttcctctctcccaag

SEQ ID NO: 5453 - DNA, 23 bp, Artificial
  target sequence
gccgtgttttcctctctcccaag

SEQ ID NO: 5454 - DNA, 23 bp, Artificial
  target sequence
cccactgggctgcagaatacaga

SEQ ID NO: 5455 - DNA, 23 bp, Artificial
  target sequence
ccccccaggagatcacatttgtc

SEQ ID NO: 5456 - DNA, 23 bp, Artificial
  target sequence
gctgccggacagtgggacctggg

SEQ ID NO: 5457 - DNA, 23 bp, Artificial
  target sequence
ctgactggacggcaccttagtga

SEQ ID NO: 5458 - DNA, 23 bp, Artificial
  target sequence
gctgtcttttcctctctccctgg

SEQ ID NO: 5459 - DNA, 23 bp, Artificial
  target sequence
ccagaaataatctttaccagctc

SEQ ID NO: 5460 - DNA, 23 bp, Artificial
  target sequence
gctgtgtttgtgcctcccccagg

SEQ ID NO: 5461 - DNA, 23 bp, Artificial
  target sequence
acaatgtgttggctcttgactag

SEQ ID NO: 5462 - DNA, 23 bp, Artificial
  target sequence
acaatgtgttggctcttgactag

SEQ ID NO: 5463 - DNA, 23 bp, Artificial
  target sequence
gacaagtctgatcattttggggg

SEQ ID NO: 5464 - DNA, 23 bp, Artificial
  target sequence
ccacggagaaacacaaacacagc

SEQ ID NO: 5465 - DNA, 23 bp, Artificial
  target sequence
aaaatgtgtcaactcttgattag

SEQ ID NO: 5466 - DNA, 23 bp, Artificial
  target sequence
aaaatgtgtcaactcttgattag

SEQ ID NO: 5467 - DNA, 23 bp, Artificial
  target sequence
tctgtgtttgcctctctctcagg

SEQ ID NO: 5468 - DNA, 23 bp, Artificial
  target sequence
acaatgtgccagctctggactag

SEQ ID NO: 5469 - DNA, 23 bp, Artificial
  target sequence
gacaagtatgagcacttggtaag

SEQ ID NO: 5470 - DNA, 23 bp, Artificial
  target sequence
gactagtgtgttctcttgggaag

SEQ ID NO: 5471 - DNA, 23 bp, Artificial
  target sequence
gacatgtgtaaacacttgggaag

SEQ ID NO: 5472 - DNA, 23 bp, Artificial
  target sequence
gacatgtgtaaacacttgggaag

SEQ ID NO: 5473 - DNA, 23 bp, Artificial
  target sequence
ccaaagtcccactgggtgacatc

SEQ ID NO: 5474 - DNA, 23 bp, Artificial
  target sequence
ccaaagtcccactgggtgacatc

SEQ ID NO: 5475 - DNA, 23 bp, Artificial
  target sequence
cctgtgagaggctcaaacacagc

SEQ ID NO: 5476 - DNA, 23 bp, Artificial
  target sequence
ccgcagtcccactgtgcggcacc

SEQ ID NO: 5477 - DNA, 23 bp, Artificial
  target sequence
ccgcagtcccactgtgcggcacc

SEQ ID NO: 5478 - DNA, 23 bp, Artificial
  target sequence
gacaagtgtgttcacttctgcag

SEQ ID NO: 5479 - DNA, 23 bp, Artificial
  target sequence
gatttgggaaagatcattccagg

SEQ ID NO: 5480 - DNA, 23 bp, Artificial
  target sequence
gctttggtaaagttgattcctag

SEQ ID NO: 5481 - DNA, 23 bp, Artificial
  target sequence
aaactgtgataactcttgactgg

SEQ ID NO: 5482 - DNA, 23 bp, Artificial
  target sequence
cctaagtcccactggccgaaagt

SEQ ID NO: 5483 - DNA, 23 bp, Artificial
  target sequence
gttctggtcaagatgactcctgg

SEQ ID NO: 5484 - DNA, 23 bp, Artificial
  target sequence
cccaggacccactgggcagcagc

SEQ ID NO: 5485 - DNA, 23 bp, Artificial
  target sequence
aaaatctgtcaactcttgaatag

SEQ ID NO: 5486 - DNA, 23 bp, Artificial
  target sequence
aaaatctgtcaactcttgaatag

SEQ ID NO: 5487 - DNA, 23 bp, Artificial
  target sequence
ctcatcaggagtggacacattgt

SEQ ID NO: 5488 - DNA, 23 bp, Artificial
  target sequence
ccagggggacacgcaaacactgc

SEQ ID NO: 5489 - DNA, 23 bp, Artificial
  target sequence
tcactttgctgccagccagttgg

SEQ ID NO: 5490 - DNA, 23 bp, Artificial
  target sequence
ctgaagtcccactgggtgggtgt

SEQ ID NO: 5491 - DNA, 23 bp, Artificial
  target sequence
gcaccagcccagtgggacttcag

SEQ ID NO: 5492 - DNA, 23 bp, Artificial
  target sequence
gcaccagcccagtgggacttcag

SEQ ID NO: 5493 - DNA, 23 bp, Artificial
  target sequence
gcaccagcccagtgggacttcag

SEQ ID NO: 5494 - DNA, 23 bp, Artificial
  target sequence
gcaccagcccagtgggacttcag

SEQ ID NO: 5495 - DNA, 23 bp, Artificial
  target sequence
ccagggaaagaggcaagcacagc

SEQ ID NO: 5496 - DNA, 23 bp, Artificial
  target sequence
ccactatacacccgcccagtcag

SEQ ID NO: 5497 - DNA, 23 bp, Artificial
  target sequence
ccattgtgctgccgcccagccag

SEQ ID NO: 5498 - DNA, 23 bp, Artificial
  target sequence
gatctggaagagatgattccaag

SEQ ID NO: 5499 - DNA, 23 bp, Artificial
  target sequence
cccgggagggaggcaaaaacagc

SEQ ID NO: 5500 - DNA, 23 bp, Artificial
  target sequence
gctgagtctgggtctctccccag

SEQ ID NO: 5501 - DNA, 23 bp, Artificial
  target sequence
gctgagtctgggtctctccccag

SEQ ID NO: 5502 - DNA, 23 bp, Artificial
  target sequence
cctggaatgttctttcccagatc

SEQ ID NO: 5503 - DNA, 23 bp, Artificial
  target sequence
cctggaatgttctttcccagatc

SEQ ID NO: 5504 - DNA, 23 bp, Artificial
  target sequence
gacaggtgtgagcactttgggag

SEQ ID NO: 5505 - DNA, 23 bp, Artificial
  target sequence
gacacttgtgatgacttgggtag

SEQ ID NO: 5506 - DNA, 23 bp, Artificial
  target sequence
ctttggagagacgcagacactgc

SEQ ID NO: 5507 - DNA, 23 bp, Artificial
  target sequence
ctttggagagacgcagacactgc

SEQ ID NO: 5508 - DNA, 23 bp, Artificial
  target sequence
cctggaatgttctttcccagatc

SEQ ID NO: 5509 - DNA, 23 bp, Artificial
  target sequence
cctggaatgttctttcccagatc

SEQ ID NO: 5510 - DNA, 23 bp, Artificial
  target sequence
ctacccaagtgttcatatttgtc

SEQ ID NO: 5511 - DNA, 23 bp, Artificial
  target sequence
ccagaaatcatgtttaccagctc

SEQ ID NO: 5512 - DNA, 23 bp, Artificial
  target sequence
ctggagtcccactgcgcggcagc

SEQ ID NO: 5513 - DNA, 23 bp, Artificial
  target sequence
cctgggaaaggcgcaaacacagc

SEQ ID NO: 5514 - DNA, 23 bp, Artificial
  target sequence
gatctgataaaggtgagtccagg

SEQ ID NO: 5515 - DNA, 23 bp, Artificial
  target sequence
gcaagttgctgccgcccagtggg

SEQ ID NO: 5516 - DNA, 23 bp, Artificial
  target sequence
tacatgagtaatcacttggggag

SEQ ID NO: 5517 - DNA, 23 bp, Artificial
  target sequence
ctccccaagtgattactcatgta

SEQ ID NO: 5518 - DNA, 23 bp, Artificial
  target sequence
ctccccaagtgattactcatgta

SEQ ID NO: 5519 - DNA, 23 bp, Artificial
  target sequence
gcagtgtgtgggtctctcccagg

SEQ ID NO: 5520 - DNA, 23 bp, Artificial
  target sequence
gcagtgtgtgggtctctcccagg

SEQ ID NO: 5521 - DNA, 23 bp, Artificial
  target sequence
tacatgagtaatcacttggggag

SEQ ID NO: 5522 - DNA, 23 bp, Artificial
  target sequence
ctccccaagtgattactcatgta

SEQ ID NO: 5523 - DNA, 23 bp, Artificial
  target sequence
ctccccaagtgattactcatgta

SEQ ID NO: 5524 - DNA, 23 bp, Artificial
  target sequence
ccaaagtcgcactggcctgcagc

SEQ ID NO: 5525 - DNA, 23 bp, Artificial
  target sequence
gatctgggagagaagattccagg

SEQ ID NO: 5526 - DNA, 23 bp, Artificial
  target sequence
ccagaaaagagttgacacatagt

SEQ ID NO: 5527 - DNA, 23 bp, Artificial
  target sequence
cctgccaagggttgacacatggt

SEQ ID NO: 5528 - DNA, 23 bp, Artificial
  target sequence
gacaagtgtcataactttggaag

SEQ ID NO: 5529 - DNA, 23 bp, Artificial
  target sequence
ataatgtgtcaaccctggaccag

SEQ ID NO: 5530 - DNA, 23 bp, Artificial
  target sequence
ccaaagacccactggacggcagc

SEQ ID NO: 5531 - DNA, 23 bp, Artificial
  target sequence
ccaaagacccactggacggcagc

SEQ ID NO: 5532 - DNA, 23 bp, Artificial
  target sequence
ccaactggccggcagcctggtga

SEQ ID NO: 5533 - DNA, 23 bp, Artificial
  target sequence
ccaactggccggcagcctggtga

SEQ ID NO: 5534 - DNA, 45 bp, Artificial
  target sequence
tatgctgccgcccagtgggactttggaaatacaatgtgtcaactc

SEQ ID NO: 5535 - DNA, 45 bp, Artificial
  target sequence
ggctgtgtttgcgtctctcccaggaatcatctttaccagatctca

SEQ ID NO: 5536 - DNA, 20 bp, Artificial
  target sequence
tatgctgccgcccagtggga

SEQ ID NO: 5537 - DNA, 25 bp, Artificial
  target sequence
atcatctttaccagatctcaaaaag

SEQ ID NO: 5538 - DNA, 25 bp, Artificial
  target sequence
gagttgacacattgtatttccaaag

SEQ ID NO: 5539 - DNA, 20 bp, Artificial
  target sequence
atcatctttaccagatctca

SEQ ID NO: 5540 - DNA, 20 bp, Artificial
  target sequence
tatgctgccgcccagtggga

SEQ ID NO: 5541 - DNA, 25 bp, Artificial
  target sequence
tcctgggagagacgcaaacacagcc

SEQ ID NO: 5542 - DNA, 25 bp, Artificial
  target sequence
tggctgtgtttgcgtctctcccagg

SEQ ID NO: 5543 - DNA, 20 bp, Artificial
  target sequence
atcatctttaccagatctca

SEQ ID NO: 5544 - DNA, 20 bp, Artificial
  target sequence
tatgctgccgcccagtggga

SEQ ID NO: 5545 - DNA, 25 bp, Artificial
  target sequence
catcatctttaccagatctcaaaaa

SEQ ID NO: 5546 - DNA, 20 bp, Artificial
  target sequence
tatgctgccgcccagtggga

SEQ ID NO: 5547 - DNA, 25 bp, Artificial
  target sequence
tttggaaatacaatgtgtcaactct

SEQ ID NO: 5548 - DNA, 20 bp, Artificial
  target sequence
tatgctgccgcccagtggga

SEQ ID NO: 5549 - DNA, 25 bp, Artificial
  target sequence
tcatctttaccagatctcaaaaaga

SEQ ID NO: 5550 - DNA, 25 bp, Artificial
  target sequence
gctgtgtttgcgtctctcccaggaa

SEQ ID NO: 5551 - DNA, 20 bp, Artificial
  target sequence
atcatctttaccagatctca

SEQ ID NO: 5552 - DNA, 20 bp, Artificial
  target sequence
tatgctgccgcccagtggga

SEQ ID NO: 5553 - DNA, 25 bp, Artificial
  target sequence
actttggaaatacaatgtgtcaact

SEQ ID NO: 5554 - DNA, 20 bp, Artificial
  target sequence
tatgctgccgcccagtggga

SEQ ID NO: 5555 - DNA, 25 bp, Artificial
  target sequence
tggaaatacaatgtgtcaactcttg

SEQ ID NO: 5556 - DNA, 25 bp, Artificial
  target sequence
gtggctgtgtttgcgtctctcccag

SEQ ID NO: 5557 - DNA, 20 bp, Artificial
  target sequence
atcatctttaccagatctca

SEQ ID NO: 5558 - DNA, 20 bp, Artificial
  target sequence
tatgctgccgcccagtggga

SEQ ID NO: 5559 - DNA, 25 bp, Artificial
  target sequence
tcctttggaaatacaatgtgtcaac

SEQ ID NO: 5560 - DNA, 20 bp, Artificial
  target sequence
tatgctgccgcccagtggga

SEQ ID NO: 5561 - DNA, 25 bp, Artificial
  target sequence
atctttaccagatctcaaaaagaag

SEQ ID NO: 5562 - DNA, 25 bp, Artificial
  target sequence
tggtggctgtgtttgcgtctctccc

SEQ ID NO: 5563 - DNA, 20 bp, Artificial
  target sequence
atcatctttaccagatctca

SEQ ID NO: 5564 - DNA, 20 bp, Artificial
  target sequence
tatgctgccgcccagtggga

SEQ ID NO: 5565 - DNA, 25 bp, Artificial
  target sequence
aatcatctttaccagatctcaaaaa

SEQ ID NO: 5566 - DNA, 25 bp, Artificial
  target sequence
tcactatgctgccgcccagtgggaa

SEQ ID NO: 5567 - DNA, 20 bp, Artificial
  target sequence
atcatctttaccagatctca

SEQ ID NO: 5568 - DNA, 20 bp, Artificial
  target sequence
tatgctgccgcccagtggga

SEQ ID NO: 5569 - DNA, 25 bp, Artificial
  target sequence
aatgtgtcaactcttgacagggctc

SEQ ID NO: 5570 - DNA, 20 bp, Artificial
  target sequence
tatgctgccgcccagtggga

SEQ ID NO: 5571 - DNA, 25 bp, Artificial
  target sequence
ttggaaatacaatgtgtcaactctt

SEQ ID NO: 5572 - DNA, 25 bp, Artificial
  target sequence
gagttacatgatcccccatgttgtg

SEQ ID NO: 5573 - DNA, 20 bp, Artificial
  target sequence
atcatctttaccagatctca

SEQ ID NO: 5574 - DNA, 25 bp, Artificial
  target sequence
gtggtggctgtgtttgcgtctcccc

SEQ ID NO: 5575 - DNA, 20 bp, Artificial
  target sequence
atcatctttaccagatctca

SEQ ID NO: 5576 - DNA, 45 bp, Artificial
  target sequence
ggctgtgtttgcgtctctcccaggtatcatctttaccagatctca

SEQ ID NO: 5577 - DNA, 20 bp, Artificial
  target sequence
tatgctgccgcccagtggga

SEQ ID NO: 5578 - DNA, 25 bp, Artificial
  target sequence
catctttaccagatctcaaaaagaa

SEQ ID NO: 5579 - DNA, 20 bp, Artificial
  target sequence
tatgctgccgcccagtggga

SEQ ID NO: 5580 - DNA, 25 bp, Artificial
  target sequence
aatacaatgtgtcaactcttgacag

SEQ ID NO: 5581 - DNA, 20 bp, Artificial
  target sequence
tatgctgccgcccagtggga

SEQ ID NO: 5582 - DNA, 25 bp, Artificial
  target sequence
atacaatgtgtcaactcttgacagg

SEQ ID NO: 5583 - DNA, 45 bp, Artificial
  target sequence
tatgctgccgcccagtgggattttggaaatacaatgtttcaactc

SEQ ID NO: 5584 - DNA, 45 bp, Artificial
  target sequence
atacaatgtgtcaactcttgacagggctctattttataggcttct

SEQ ID NO: 5585 - DNA, 45 bp, Artificial
  target sequence
ggctcactatgctgccgcccagtgggactttggaaatacaatgtg

SEQ ID NO: 5586 - DNA, 20 bp, Artificial
  target sequence
ggctcactatgctgccgccc

SEQ ID NO: 5587 - DNA, 25 bp, Artificial
  target sequence
gacagggctctattttataggcttc

SEQ ID NO: 5588 - DNA, 20 bp, Artificial
  target sequence
ggctcactatgctgccgccc

SEQ ID NO: 5589 - DNA, 25 bp, Artificial
  target sequence
tgacagggctctattttataggctt

SEQ ID NO: 5590 - DNA, 20 bp, Artificial
  target sequence
ggctcactatgctgccgccc

SEQ ID NO: 5591 - DNA, 25 bp, Artificial
  target sequence
ttgacagggctctattttataggct

SEQ ID NO: 5592 - DNA, 19 bp, Artificial
  target sequence
aatacaatgtgtcaactct

SEQ ID NO: 5593 - DNA, 26 bp, Artificial
  target sequence
gacagggctctattttataggcttct

SEQ ID NO: 5594 - DNA, 19 bp, Artificial
  target sequence
ccggcaaacaaaccaccgc

SEQ ID NO: 5595 - DNA, 26 bp, Artificial
  target sequence
gacagggctctattttataggcttct

SEQ ID NO: 5596 - DNA, 45 bp, Artificial
  target sequence
ggctcactatgctgccgcccagggggactttggaaatacaatgtg

SEQ ID NO: 5597 - DNA, 19 bp, Artificial
  target sequence
gaaatacaatgtgtcaact

SEQ ID NO: 5598 - DNA, 26 bp, Artificial
  target sequence
gacagggctctattttataggcttct

SEQ ID NO: 5599 - DNA, 20 bp, Artificial
  target sequence
ggctcactatgctgccgccc

SEQ ID NO: 5600 - DNA, 25 bp, Artificial
  target sequence
gggactttggaaatacaatgtgtca

SEQ ID NO: 5601 - DNA, 22 bp, Artificial
  target sequence
tcactatacaatgtgtcaagac

SEQ ID NO: 5602 - DNA, 23 bp, Artificial
  target sequence
agggctctattttataggcttct

SEQ ID NO: 5603 - DNA, 19 bp, Artificial
  target sequence
aaatacaatgtgtcaactc

SEQ ID NO: 5604 - DNA, 26 bp, Artificial
  target sequence
gacagggctctattttataggcttct

SEQ ID NO: 5605 - DNA, 20 bp, Artificial
  target sequence
ggctcactatgctgccgccc

SEQ ID NO: 5606 - DNA, 25 bp, Artificial
  target sequence
aacagggctctattttataggcttc

SEQ ID NO: 5607 - DNA, 45 bp, Artificial
  target sequence
atacaatgtgtcaactcttgacaaggctctattttataggcttct

SEQ ID NO: 5608 - DNA, 20 bp, Artificial
  target sequence
cccagtgggactttggaaaa

SEQ ID NO: 5609 - DNA, 25 bp, Artificial
  target sequence
acagggctctattttataggcttct

SEQ ID NO: 5610 - DNA, 19 bp, Artificial
  target sequence
atacaatgtgtcaactcct

SEQ ID NO: 5611 - DNA, 26 bp, Artificial
  target sequence
gacagggctctattttataggcttct

SEQ ID NO: 5612 - DNA, 19 bp, Artificial
  target sequence
atacaatgtgtcaactctc

SEQ ID NO: 5613 - DNA, 26 bp, Artificial
  target sequence
gacagggctctattttataggcttct

SEQ ID NO: 5614 - DNA, 45 bp, Artificial; identical to SEQ ID NO: 5585
  target sequence

SEQ ID NO: 5615 - DNA, 45 bp, Artificial
  target sequence
gggtggtggctgtgtttgcgtctctcccaggaatcatctttacca

SEQ ID NO: 5616 - DNA, 25 bp, Artificial
  target sequence
ttctgggctcactatgctgccgccc

SEQ ID NO: 5617 - DNA, 20 bp, Artificial
  target sequence
cccaggaatcatctttacca

SEQ ID NO: 5618 - DNA, 20 bp, Artificial
  target sequence
ggctcactatgctgccgccc

SEQ ID NO: 5619 - DNA, 25 bp, Artificial
  target sequence
cccaggaatcatctttaccagatct

SEQ ID NO: 5620 - DNA, 20 bp, Artificial
  target sequence
ggctcactatgctgccgccc

SEQ ID NO: 5621 - DNA, 25 bp, Artificial
  target sequence
tcccaggaatcatctttaccagatc

SEQ ID NO: 5622 - DNA, 25 bp, Artificial
  target sequence
tctgggctcactatgctgccgccct

SEQ ID NO: 5623 - DNA, 20 bp, Artificial
  target sequence
cccaggaatcatctttacca

SEQ ID NO: 5624 - DNA, 20 bp, Artificial
  target sequence
ggctcactatgctgccgccc

SEQ ID NO: 5625 - DNA, 25 bp, Artificial
  target sequence
agagacgcaaacacagccaccaccc

SEQ ID NO: 5626 - DNA, 25 bp, Artificial
  target sequence
cacattgtatttccaaagtcccact

SEQ ID NO: 5627 - DNA, 20 bp, Artificial
  target sequence
cccaggaatcatctttacca

SEQ ID NO: 5628 - DNA, 20 bp, Artificial
  target sequence
ggctcactatgctgccgccc

SEQ ID NO: 5629 - DNA, 25 bp, Artificial
  target sequence
aatgtgtcaactcttgacagggctc

SEQ ID NO: 5630 - DNA, 20 bp, Artificial
  target sequence
ggctcactatgctgccgccc

SEQ ID NO: 5631 - DNA, 25 bp, Artificial
  target sequence
agagacgcaaacacagccaccaccc

SEQ ID NO: 5632 - DNA, 25 bp, Artificial
  target sequence
acattgtatttccaaagtcccactt

SEQ ID NO: 5633 - DNA, 20 bp, Artificial
  target sequence
cccaggaatcatctttacca

SEQ ID NO: 5634 - DNA, 25 bp, Artificial
  target sequence
ggtggtggctgtgtttgcgtctctt

SEQ ID NO: 5635 - DNA, 20 bp, Artificial
  target sequence
cccaggaatcatctttacca

SEQ ID NO: 5636 - DNA, 20 bp, Artificial
  target sequence
ggctcactatgctgccgccc

SEQ ID NO: 5637 - DNA, 25 bp, Artificial
  target sequence
tagtgggactttggaaatacaatgt

SEQ ID NO: 5638 - DNA, 25 bp, Artificial
  target sequence
cttctgggctcactatgctgccgcc

SEQ ID NO: 5639 - DNA, 20 bp, Artificial
  target sequence
cccaggaatcatctttacca

SEQ ID NO: 5640 - DNA, 25 bp, Artificial
  target sequence
gctgtttcctgtgtgaaattgttat

SEQ ID NO: 5641 - DNA, 20 bp, Artificial
  target sequence
cccaggaatcatctttacca

SEQ ID NO: 5642 - DNA, 25 bp, Artificial
  target sequence
cccttctgggctcactatgctgccg

SEQ ID NO: 5643 - DNA, 20 bp, Artificial
  target sequence
cccaggaatcatctttacca

SEQ ID NO: 5644 - DNA, 20 bp, Artificial
  target sequence
ggctcactatgctgccgccc

SEQ ID NO: 5645 - DNA, 25 bp, Artificial
  target sequence
aggaatcatctttaccagatctcaa

SEQ ID NO: 5646 - DNA, 20 bp, Artificial
  target sequence
ggctcactatgctgccgccc

SEQ ID NO: 5647 - DNA, 25 bp, Artificial
  target sequence
ccaggaatcatctttaccagatctc

SEQ ID NO: 5648 - DNA, 20 bp, Artificial
  target sequence
ggctcactatgctgccgccc

SEQ ID NO: 5649 - DNA, 25 bp, Artificial
  target sequence
ttactgtcgtccatgctgtgtttgc

SEQ ID NO: 5650 - DNA, 24 bp, Artificial
  target sequence
ttctgggctcactatgctgccgcc

SEQ ID NO: 5651 - DNA, 21 bp, Artificial
  target sequence
tcccaggaatcatctttacca

SEQ ID NO: 5652 - DNA, 20 bp, Artificial
  target sequence
ggctcactatgctgccgccc

SEQ ID NO: 5653 - DNA, 25 bp, Artificial
  target sequence
tgtataccgtcgacctctagctaga

SEQ ID NO: 5654 - DNA, 20 bp, Artificial
  target sequence
ggctcactatgctgccgccc

SEQ ID NO: 5655 - DNA, 25 bp, Artificial
  target sequence
ttaccagatctcaaaaagaaggtct

SEQ ID NO: 5656 - DNA, 20 bp, Artificial
  target sequence
ggctcactatgctgccgccc

SEQ ID NO: 5657 - DNA, 25 bp, Artificial
  target sequence
cagtgggactttggaaatacaatgt

SEQ ID NO: 5658 - DNA, 20 bp, Artificial
  target sequence
ggctcactatgctgccgccc

SEQ ID NO: 5659 - DNA, 25 bp, Artificial
  target sequence
tgggactttggaaatacaatgtgtc

SEQ ID NO: 5660 - DNA, 20 bp, Artificial
  target sequence
ggctcactatgctgccgccc

SEQ ID NO: 5661 - DNA, 25 bp, Artificial
  target sequence
aatacaatgtgtcaactcttgacag

SEQ ID NO: 5662 - DNA, 20 bp, Artificial
  target sequence
ggctcactatgctgccgccc

SEQ ID NO: 5663 - DNA, 25 bp, Artificial
  target sequence
tctcccaggaatcatctttaccaga

SEQ ID NO: 5664 - DNA, 25 bp, Artificial
  target sequence
tgggctcactatgctgccgccctct

SEQ ID NO: 5665 - DNA, 20 bp, Artificial
  target sequence
cccaggaatcatctttacca

SEQ ID NO: 5666 - DNA, 25 bp, Artificial
  target sequence
tactgtccccttctgggctcactat

SEQ ID NO: 5667 - DNA, 20 bp, Artificial
  target sequence
cccaggaatcatctttacca

SEQ ID NO: 5668 - DNA, 25 bp, Artificial
  target sequence
tgggtggtggctgtgtttgcgtctt

SEQ ID NO: 5669 - DNA, 20 bp, Artificial
  target sequence
cccaggaatcatctttacca

SEQ ID NO: 5670 - DNA, 25 bp, Artificial
  target sequence
acttgggtggtggctgtgtttgcgt

SEQ ID NO: 5671 - DNA, 20 bp, Artificial
  target sequence
cccaggaatcatctttacca

SEQ ID NO: 5672 - DNA, 20 bp, Artificial
  target sequence
ggctcactatgctgccgccc

SEQ ID NO: 5673 - DNA, 25 bp, Artificial
  target sequence
aagtgggactttggaaatacaatgt

SEQ ID NO: 5674 - DNA, 20 bp, Artificial
  target sequence
ggctcactatgctgccgccc

SEQ ID NO: 5675 - DNA, 25 bp, Artificial
  target sequence
gtgggactttggaaatacaatgtgt

SEQ ID NO: 5676 - DNA, 20 bp, Artificial
  target sequence
ggctcactatgctgccgccc

SEQ ID NO: 5677 - DNA, 25 bp, Artificial
  target sequence
ttataggcttcttctctggaatctt

SEQ ID NO: 5678 - DNA, 20 bp, Artificial
  target sequence
ggctcactatgctgccgccc

SEQ ID NO: 5679 - DNA, 25 bp, Artificial
  target sequence
tcttcatcatcctcctgacaatcga

SEQ ID NO: 5680 - DNA, 25 bp, Artificial
  target sequence
ttcttcgatcagtctaaaaatggct

SEQ ID NO: 5681 - DNA, 20 bp, Artificial
  target sequence
cccaggaatcatctttacca

SEQ ID NO: 5682 - DNA, 20 bp, Artificial
  target sequence
ggctcactatgctgccgccc

SEQ ID NO: 5683 - DNA, 25 bp, Artificial
  target sequence
catctttaccagatctcaaaaagaa

SEQ ID NO: 5684 - DNA, 20 bp, Artificial
  target sequence
ggctcactatgctgccgccc

SEQ ID NO: 5685 - DNA, 25 bp, Artificial
  target sequence
aataggcttcttctctggaatcttc

SEQ ID NO: 5686 - DNA, 20 bp, Artificial
  target sequence
ggctcactatgctgccgccc

SEQ ID NO: 5687 - DNA, 25 bp, Artificial
  target sequence
tttggggtggtgacaagtgtgatca

SEQ ID NO: 5688 - DNA, 20 bp, Artificial
  target sequence
ggctcactatgctgccgccc

SEQ ID NO: 5689 - DNA, 25 bp, Artificial
  target sequence
ttaaaagccaggacggtcacctttg

SEQ ID NO: 5690 - DNA, 20 bp, Artificial
  target sequence
ggctcactatgctgccgccc

SEQ ID NO: 5691 - DNA, 25 bp, Artificial
  target sequence
tgtttgcgtctctcccaggaatcat

SEQ ID NO: 5692 - DNA, 25 bp, Artificial
  target sequence
agtgtgatcacttgggtggtggctg

SEQ ID NO: 5693 - DNA, 20 bp, Artificial
  target sequence
cccaggaatcatctttacca

SEQ ID NO: 5694 - DNA, 20 bp, Artificial
  target sequence
ggctcactatgctgccgccc

SEQ ID NO: 5695 - DNA, 25 bp, Artificial
  target sequence
tctggaatcttcttcatcatcctcc

SEQ ID NO: 5696 - DNA, 45 bp, Artificial
  target sequence
ggctcactatgctgccgccctgtgggactttggaaatacaatgtg

SEQ ID NO: 5697 - DNA, 20 bp, Artificial
  target sequence
ggctcactatgctgccgccc

SEQ ID NO: 5698 - DNA, 25 bp, Artificial
  target sequence
tttggaaatacaatgtgtcaactct

SEQ ID NO: 5699 - DNA, 25 bp, Artificial
  target sequence
ccttctgggctcactatgctgccgc

SEQ ID NO: 5700 - DNA, 20 bp, Artificial
  target sequence
cccaggaatcatctttacca

SEQ ID NO: 5701 - DNA, 20 bp, Artificial
  target sequence
ggctcactatgctgccgccc

SEQ ID NO: 5702 - DNA, 25 bp, Artificial
  target sequence
cccaagaatcatctttaccagatct

SEQ ID NO: 5703 - DNA, 25 bp, Artificial
  target sequence
tgggtggtggctgtgtttgcgtctc

SEQ ID NO: 5704 - DNA, 20 bp, Artificial
  target sequence
cccaggaatcatctttacca

SEQ ID NO: 5705 - DNA, 20 bp, Artificial
  target sequence
ggctcactatgctgccgccc

SEQ ID NO: 5706 - DNA, 25 bp, Artificial
  target sequence
acaatgtgtcaactcttgacagggc

SEQ ID NO: 5707 - DNA, 20 bp, Artificial
  target sequence
ggctcactatgctgccgccc

SEQ ID NO: 5708 - DNA, 25 bp, Artificial
  target sequence
gtgggactttggaaattcaatgtgt

SEQ ID NO: 5709 - DNA, 20 bp, Artificial
  target sequence
ggctcactatgctgccgccc

SEQ ID NO: 5710 - DNA, 25 bp, Artificial
  target sequence
gcccaggaatcatctttaccagatc

SEQ ID NO: 5711 - DNA, 20 bp, Artificial
  target sequence
ggctcactatgctgccgccc

SEQ ID NO: 5712 - DNA, 25 bp, Artificial
  target sequence
ggctgtgtttgcgtctctccaggaa

SEQ ID NO: 5713 - DNA, 25 bp, Artificial
  target sequence
tcttactgtccccttctgcgtctct

SEQ ID NO: 5714 - DNA, 20 bp, Artificial
  target sequence
cccaggaatcatctttacca

SEQ ID NO: 5715 - DNA, 25 bp, Artificial
  target sequence
ggtggtggctgtgtttgcgtctctc

SEQ ID NO: 5716 - DNA, 20 bp, Artificial
  target sequence
cccaggaatcatctttacca

SEQ ID NO: 5717 - DNA, 23 bp, Artificial
  target sequence
ccaggaatcatctttactaaatg

SEQ ID NO: 5718 - DNA, 23 bp, Artificial
  target sequence
ccaggcatcttctttaccagctc

SEQ ID NO: 5719 - DNA, 23 bp, Artificial
  target sequence
aaaatgtgtcaactcttgattag

SEQ ID NO: 5720 - DNA, 23 bp, Artificial
  target sequence
aaaatgtgtcaactcttgattag

SEQ ID NO: 5721 - DNA, 23 bp, Artificial
  target sequence
cccactgggctgcagaatacaga

SEQ ID NO: 5722 - DNA, 23 bp, Artificial
  target sequence
tctgtgtttgcctctctctcagg

SEQ ID NO: 5723 - DNA, 23 bp, Artificial
  target sequence
cccgggagggaggcaaaaacagc

SEQ ID NO: 5724 - DNA, 47 bp, Artificial
  target sequence
tcccttcctgcctcatttcaggtgaatacatcaagacctggaggcca

SEQ ID NO: 5725 - DNA, 47 bp, Artificial; identical to SEQ ID NO: 5724
  target sequence

SEQ ID NO: 5726 - DNA, 47 bp, Artificial
  target sequence
tgctggctcggctgccctgaggttgctcaatcaagcacaggtttcaa

SEQ ID NO: 5727 - DNA, 47 bp, Artificial; identical to SEQ ID NO: 5726
  target sequence

SEQ ID NO: 5728 - DNA, 47 bp, Artificial
  target sequence
taacagcgatgctgaccccctgtgcctctaccacttctatgaccaga

SEQ ID NO: 5729 - DNA, 47 bp, Artificial
  target sequence
cgatgctgaccccctgtgcctctaccacttctatgaccagatggacc

SEQ ID NO: 5730 - DNA, 49 bp, Artificial
  target sequence
tggtccttgctgtgttctctgcggtgcttggctccctgcagtttgggta

SEQ ID NO: 5731 - DNA, 49 bp, Artificial; identical to SEQ ID NO: 5730
  target sequence

SEQ ID NO: 5732 - DNA, 47 bp, Artificial
  target sequence
tgggcgacagatgcgaaagaaacgagttccagtgccaagacgggaaa

SEQ ID NO: 5733 - DNA, 47 bp, Artificial
  target sequence
gaaacgagttccagtgccaagacgggaaatgcatctcctacaagtgg

SEQ ID NO: 5734 - DNA, 48 bp, Artificial
  target sequence
tcagagaggacactgcagttgtccgtgctagtagccttcgcttctgga

SEQ ID NO: 5735 - DNA, 48 bp, Artificial; identical to SEQ ID NO: 5734
  target sequence

SEQ ID NO: 5736 - DNA, 47 bp, Artificial
  target sequence
tgatgatctcagaggctcagtatccttgtcctgggttggagatagca

SEQ ID NO: 5737 - DNA, 47 bp, Artificial; identical to SEQ ID NO: 5736
  target sequence

SEQ ID NO: 5738 - DNA, 49 bp, Artificial
  target sequence
tggtaattatgacttttggacagtccaagctatatcgaaggtgagatca

SEQ ID NO: 5739 - DNA, 49 bp, Artificial; identical to SEQ ID NO: 5738
  target sequence

SEQ ID NO: 5740 - DNA, 47 bp, Artificial; identical to SEQ ID NO: 5724
  target sequence

SEQ ID NO: 5741 - DNA, 47 bp, Artificial; identical to SEQ ID NO: 5724
  target sequence

SEQ ID NO: 5742 - DNA, 47 bp, Artificial
  target sequence
ctatgccctgcctcatttcaggtgaagatgaaatccctggagcttgg

SEQ ID NO: 5743 - protein, 4 aa, Homo sapiens
PPPV

SEQ ID NO: 5744 - DNA, 10 bp, Artificial
  target sequence
accttttgcc

SEQ ID NO: 5745 - DNA, 14 bp, Artificial
  target sequence
ctttctgagaactt

What is claimed is:

1. A method for altering a target sickle cell disease (SCD)-associated polynucleotide sequence in a cell comprising contacting the SCD-associated polynucleotide sequence with a clustered regularly interspaced short palindromic repeats-associated (Cas) protein and from one to two ribonucleic acids, wherein the ribonucleic acids direct Cas protein to and hybridize to a target motif of the target SCD-associated polynucleotide sequence comprising nucleotides located between position 5246806 and position 5248263 of human chromosome 11, wherein the target SCD-associated polynucleotide sequence is cleaved, and wherein the efficiency of alteration is from about 50% to about 80%.

2. A method according to claim 1, wherein the Cas protein is *Streptococcus pyogenes* Cas9 protein or a functional portion thereof selected from the group consisting of a DNA binding domain, at least one RNA binding domain, a helicase domain, and an endonuclease domain.

3. A method according to claim 1, wherein the Cas protein is Cas9 protein from any bacterial species or functional portion thereof selected from the group consisting of a DNA binding domain, at least one RNA binding domain, a helicase domain, and an endonuclease domain.

4. A method according to claim 1, wherein the Cas protein is complexed with the one to two ribonucleic acids.

5. A method according to claim 1, wherein the target motif is $G(N)_{19}NGG$ or $(N)_{20}NGG$.

6. A method according to claim 1, wherein the alteration results in reduced expression of the target polynucleotide sequence, a knock out of the target polynucleotide sequence, or correction of the target polynucleotide sequence from an undesired sequence to a desired sequence.

7. A method according to claim 1, wherein the cell is selected from the group consisting of a peripheral blood cell, a stem cell, a pluripotent cell, a hematopoietic stem cell, a CD34+cell, a CD34+ mobilized peripheral blood cell, a CD34+ cord blood cell, a CD34+ bone marrow cell, a $CD34^+CD38\text{-Lineage-}CD90^+CD45RA^-$ cell, a primary human cell, a non-transformed human cell, and combinations thereof.

8. A method according to claim 1, wherein one or two ribonucleic acids hybridize to a target motif that contains at least one mismatch when compared with all other genomic nucleotide sequences in the cell.

9. A method according to claim 1, wherein the Cas protein is encoded by a modified nucleic acid selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate.

10. A method according to claim 1, wherein at least one of the ribonucleic acids is a modified ribonucleic acid comprising one to two modified nucleotides selected from the group consisting of pseudouridine, 5-methylcytodine, 2-thio-uridine, 5-methyluridine-5'-triphosphate, 4-thiouridine-5'-triphosphate, 5,6-dihydrouridine-5'-triphosphate, and 5-azauridine-5'-triphosphate.

11. A method according to claim 1, wherein the cell was selected for Cas protein expression.

* * * * *